United States Patent
Liu et al.

(10) Patent No.: US 12,060,586 B2
(45) Date of Patent: Aug. 13, 2024

(54) CELL DATA RECORDERS AND USES THEREOF

(71) Applicant: The Broad Institute, Inc., Cambridge, MA (US)

(72) Inventors: David R. Liu, Lexington, MA (US); Weixin Tang, Somerville, MA (US)

(73) Assignee: The Broad Institute, Inc., Cambridge, MA (US)

( * ) Notice: Subject to any disclaimer, the term of this patent is extended or adjusted under 35 U.S.C. 154(b) by 967 days.

(21) Appl. No.: 16/970,115

(22) PCT Filed: Feb. 15, 2019

(86) PCT No.: PCT/US2019/018285
§ 371 (c)(1),
(2) Date: Aug. 14, 2020

(87) PCT Pub. No.: WO2019/161251
PCT Pub. Date: Aug. 22, 2019

(65) Prior Publication Data
US 2021/0363508 A1 Nov. 25, 2021

Related U.S. Application Data

(60) Provisional application No. 62/758,241, filed on Nov. 9, 2018, provisional application No. 62/631,455, filed on Feb. 15, 2018.

(51) Int. Cl.
*C12N 9/22* (2006.01)
*C12N 15/11* (2006.01)
*C12Q 1/02* (2006.01)

(52) U.S. Cl.
CPC ............. *C12N 9/22* (2013.01); *C12N 15/11* (2013.01); *C12Q 1/02* (2013.01); *C12N 2310/20* (2017.05); *C12N 2800/101* (2013.01); *C12N 2800/107* (2013.01); *C12N 2800/80* (2013.01)

(58) Field of Classification Search
CPC ...... C12N 9/22; C12N 15/11; C12N 2310/20; C12N 2800/101; C12N 2800/107; C12N 2800/80; C12N 15/1086; C12Q 1/02; C12Q 1/6897
See application file for complete search history.

(56) References Cited

U.S. PATENT DOCUMENTS

2015/0059010 A1* 2/2015 Cigan ................. C12N 15/00 800/298
2016/0312199 A1* 10/2016 Joung ................. C12N 15/63

FOREIGN PATENT DOCUMENTS

WO WO-2016/205728 A1 12/2016
WO WO-2019/161251 A1 8/2019

OTHER PUBLICATIONS

Ramakrishna, Suresh, et al. "Surrogate reporter-based enrichment of cells containing RNA-guided Cas9 nuclease-induced mutations." Nature communications 5.1 (2014): 3378 (Year: 2014).*
Farzadfard, Fahim, and Timothy K. Lu. "Genomically encoded analog memory with precise in vivo DNA writing in living cell populations." Science 346.6211 (2014): 1256272 (Year: 2014).*
Tang (Science 360.6385 (Feb. 15, 2018): eaap8992) (Year: 2018).*
Berlec et al., "Single plasmid systems for inducible dual protein expression and for CRISPR-Cas9/CRISPRi gene regulation in lactic acid bacterium Lactococcus lactis," Sci Rep 8(1):7-9 (2018).
International Search Report and Written Opinion for International Application No. PCT/US2019/018285 dated Jul. 15, 2019.
Invitation to Pay Additional Fees for International Application No. PCT/US2019/018285 dated May 24, 2019.
Lauritsen et al., "A versatile one-step CRISPR-Cas9 based approached to plasmid-curing," Microb Cell Fact 16(1):1-10 (2017).
Shur et al., "Proof of concept continuous event logging in living cells," bioRxiv: 16 pages (2017).

* cited by examiner

*Primary Examiner* — Nancy J Leith
*Assistant Examiner* — Kyle Thomas Rega
(74) *Attorney, Agent, or Firm* — Foley Hoag LLP

(57) ABSTRACT

Described herein are compositions, vectors, cells, methods, and kits that provide cell data recorder systems for recording cell states. The cell data recorder systems allow for the recording of both the presence and duration of one or more stimuli in a programmable, reproducible, and multiplexable manner. These cell data recorder systems employ a nucleic acid programmable DNA binding protein, such as a Cas9 nuclease, or a fusion protein comprising a nucleic acid programmable DNA binding domain and a nucleic acid editing domain to introduce recordable changes in the genome of a cell or in a plasmid within the cell.

10 Claims, 27 Drawing Sheets

Specification includes a Sequence Listing.

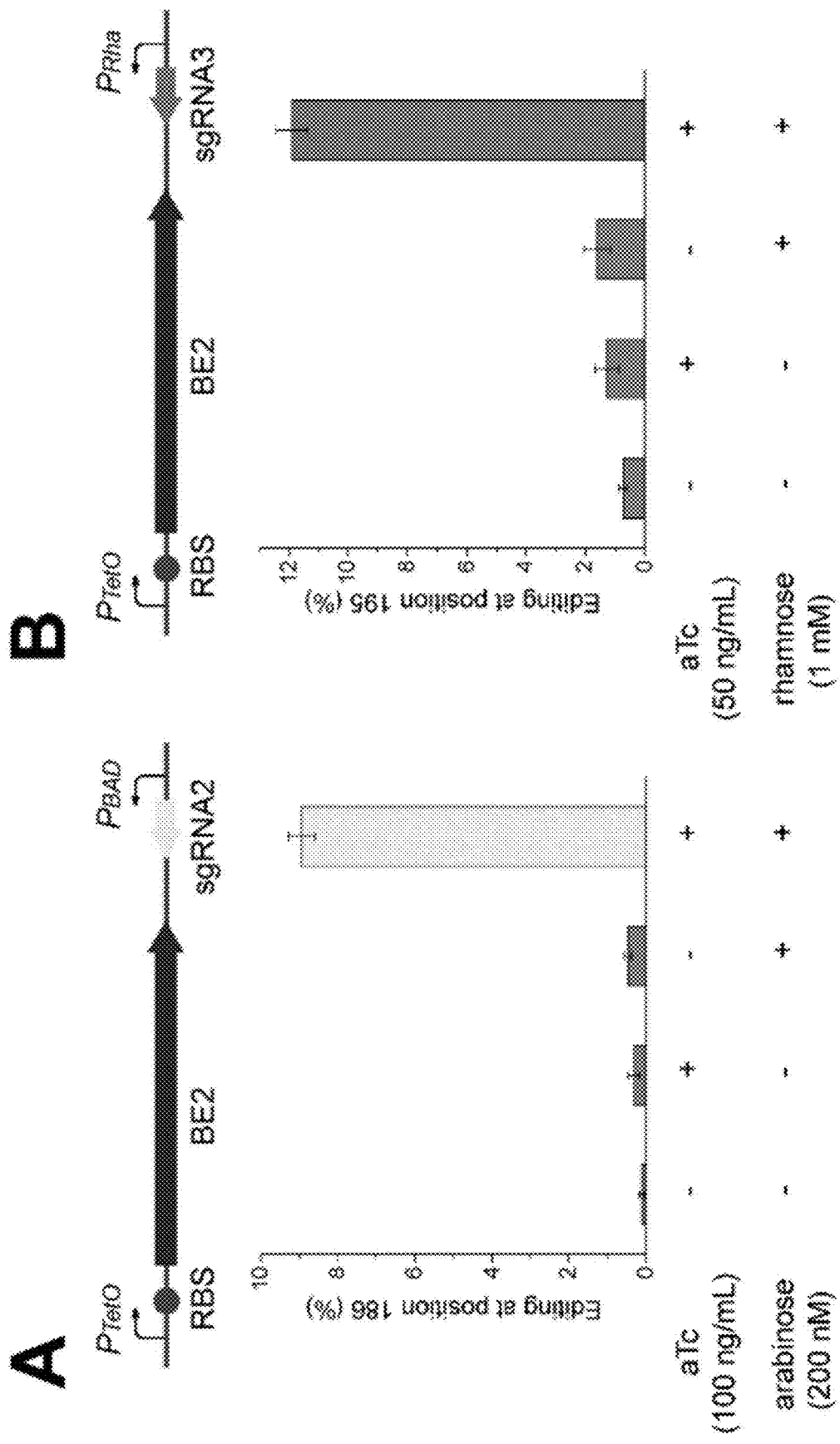
FIG. 11A and B

CELL DATA RECORDERS AND USES THEREOF

RELATED APPLICATIONS

This application is the 371 National Stage of International Patent Application NO. PCT/US2019/018285, filed Feb. 15, 2019, which claims the benefit of priority to U.S. Provisional Patent Application Ser. No. 62/631,455, filed Feb. 15, 2018, and U.S. Provisional Patent Application Ser. No. 62/758, 241, filed Nov. 9, 2018, which are herein incorporated by reference in its entirety.

SEQUENCE LISTING

The application contains a sequence listing which has been submitted electronically in ASCII format and is hereby incorporated by reference in its entirety. Said ASCII copy, created on May 3, 2019, is named BRB-01325 Sequence Listing.txt and is 3,833,000 bytes in size.

BACKGROUND

Despite the potential impact, tools capable of revealing a cell's history, and how cellular history impacts both present and future cell states, are far less developed than recent technologies that enable the study of internal cell state in detail. Detailed information on cell states during division and differentiation could illuminate the process of aging, while recording the presence and duration of exposure to external and internal stresses could give insight into the emergence of cancer or other diseases. However, recording a cell's history in a multiplexable, durable, and minimally perturbative manner has been a long-standing challenge.

SUMMARY

Provided herein are compositions (e.g., nucleic acids), cells, systems, kits, and methods for recording the strength and/or duration of endogenous or exogenous stimuli over the course of a cell's lifetime. Some aspects of the disclosure provide a cell data recording system comprising a nucleic acid programmable DNA binding protein (napDNAbp) (e.g., a Cas9 domain) or a fusion protein comprising a nucleic acid programmable DNA binding protein and a nucleic acid editing domain (e.g., a base editor) operably linked to a promoter that induces the expression of the napDNA or the fusion protein to induce changes in cellular DNA (e.g., double-strand breaks, nucleobase editing) in response to a stimulus or change in cell. In contrast to digital memory devices that store information (e.g., the presence or absence of a stimulus) in one of two distinct states (i.e., "on" or "off"), these cell data recorders can induce permanent marks in cellular DNA in a manner that reflects both the strength (i.e., amplitude) and duration of one or more stimuli. Thus, in some aspects, provided herein are analog, multi-event cell data recording systems (also referred to as a "CRISPR-mediated analog multi-event recording apparatus" or "CAMERA") that have the ability to simultaneously record multiple cell states, including, for example, exposure to a small molecule, a protein, a peptide, an amino acid, a metabolite, a sugar, a molecule produced during the activation of an endogenous or an exogenous signaling cascade, light, heat, mechanical stress, or a virus. Certain embodiments of these cell data recorders employ sequencing technologies (e.g., high-throughput sequencing) to measure readout (e.g., changes in cellular DNA) and are not dependent on large cell populations for both the recording of a stimulus or the readout of the change(s) in cellular DNA induced by the stimulus.

The clustered regularly interspaced short palindromic repeat (CRISPR) system is a prokaryotic adaptive immune system that has been modified to enable robust and general genome engineering in a variety of organisms and cell lines (see, e.g., Jansen et al. Identification of genes that are associated with DNA repeats in prokaryotes. *Mol Microbiol.* 2002; 43(6): 1565-75; and Mali et al. Cas9 as a versatile tool for engineering biology. *Nat Methods.* 2013; 10(10): 957-63). CRISPR-Cas (CRISPR-associated) systems are protein-RNA complexes that use an RNA molecule (gRNA) as a guide to localize the complex to a target DNA sequence via base-pairing (see, e.g., Jore et al. Structural basis for CRISPR RNA-guided DNA recognition by Cascade. *Nat Struct Mol Biol.* 2011; 18(5): 529-36). In the natural systems, a Cas protein then acts as an endonuclease to cleave the targeted double-stranded DNA sequence (see, e.g., Horvath P and Barrangou R. CRISPR/Cas, the immune system of bacteria and archaea. *Science.* 2010; 327(5962): 167-70). Thus, this disclosure contemplates the use of such nucleic acid programmable DNA binding proteins (e.g., Cas9) for inducing recordable changes in a genome (e.g., the genome of a bacteria or human subject), such as the introduction of double-stranded DNA breaks. Among the known Cas proteins, *Streptococcus pyogenes* Cas9 (spCas9) has been the most widely used as a tool for genome engineering (see, e.g., Gasiunas G and Siksnys V. RNA-dependent DNA endonuclease Cas9 of the CRISPR system: Holy Grail of genome editing? *Trends Microbiol.* 2013; 21(11): 562-7). This Cas9 protein is a large, multi-domain protein containing two distinct nuclease domains. Point mutations can be introduced into these nuclease domains of Cas9 to abolish nuclease activity, resulting in a nuclease inactive Cas9 domain that still retains its ability to bind DNA in a sgRNA-programmed manner (see, e.g., Qi et al. Repurposing CRISPR as an RNA-guided platform for sequence-specific control of gene expression. *Cell.* 2013; 152(5): 1173-83). In principle, such Cas9 variants, when fused to another protein or domain, can target that protein to virtually any DNA sequence by co-expression with an appropriate sgRNA Thus, this disclosure also contemplates fusion proteins comprising such Cas9 variants and a nucleic acid editing domain (e.g., a deaminase, a nuclease, a nickase, a recombinase, a methyltransferase, a methylase, an acetylase, an acetyltransferase, a transcriptional activator, or a transcriptional repressor domain), as well as the use of such fusion proteins for inducing recordable nucleobase changes in a genome (e.g., the genome of a bacterial or human cell).

In the examples provided herein, certain exemplary cell data recorders comprise a writing plasmid and either one or more recorder plasmids or a recorder locus for recording changes in the DNA of a cell, or the DNA of a plasmid (e.g., a recording plasmid) provided by the cell data recorder system, (e.g., double-strand breaks, nucleobase editing) as a result of the activity of the napDNAbp or fusion protein. Without wishing to be bound by any particular theory, the components of the writing plasmid (e.g., napDNAbp, fusion protein, sgRNA) are generally operably linked to a promoter sequence which controls the expression of each component. In some embodiments, the components of the writing plasmid (e.g., napDNAbp, fusion protein, sgRNA) are operably linked to a single inducible promoter, such that the presence of the stimulus (e.g., a small molecule, a protein, a peptide, an amino acid, a metabolite, a sugar, a molecule produced during the activation of an endogenous or an exogenous signaling cascade, light, heat, mechanical stress, a virus, etc.) induces expression of all the components of the writing plasmid simultaneously. In some embodiments, one or more of the components of the writing plasmid (e.g., napDNAbp, base editor, sgRNA) are operably linked to a constitutively active promoter, such that the component is constitutively expressed in cells. In some embodiments, each component of the writing plasmid (e.g., napDNAbp, fusion protein, sgRNA) is operably linked to a different inducible promoter, where expression of each component is only initiated in the presence of the corresponding stimulus (e.g., small molecule, antibiotic, metabolite, protein, peptide, amino acid, molecule produced during an activated cell signaling cascade, light, heat, virus, etc). The use of multiple different inducible promoters operably linked to separate components of the cell data recorder system (e.g., writing plasmid, recording plasmid, one or more additional plasmids) allows for the generation of cell data recorders that recapitulate an "OR" logic gate, where signal output (e.g., double-strand breaks, nucleobase editing) is only recorded in the presence of the desired stimulus to be measured, but not in the presence of an undesired stimulus. In addition, the use of multiple different inducible promoters operably linked to separate components of the cell data recorder system (e.g., writing plasmid, recording plasmid, one or more additional plasmids) allows for the generation of cell data recorders that recapitulate an "AND" Boolean logic gate, where signal output (e.g., double-strand breaks, nucleobase editing) is only recorded in the presence of all required stimuli, but not in the presence of only one stimulus (see, e.g., FIG. 2).

Thus, in one aspect, provided herein is a writing plasmid comprising: (i) a nucleic acid sequence encoding a nucleic acid programmable DNA binding protein (napDNAbp) operably linked to a first promoter; (ii) a nucleic acid sequence encoding a single guide RNA (sgRNA) operably linked to a second promoter, wherein the sgRNA is complementary to a target sequence; and, optionally, (iii) an origin of replication; wherein at least one of the promoters is an inducible promoter, and wherein the sgRNA associates with the napDNAbp under conditions that induce expression of the sgRNA and expression of the napDNAbp.

In another aspect, provided herein is a writing plasmid for use in a bacterial cell comprising (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a sgRNA operably linked to a second promoter, wherein the sgRNA is complementary to a target sequence; and (iii) an origin of replication, wherein at least one of the promoters is an inducible promoter, and wherein the sgRNA associates with the napDNAbp under conditions that induce the expression of the fusion protein and expression of the sgRNA.

In another aspect, provided herein is a writing plasmid for use in a eukaryotic cell comprising (i) a nucleic acid sequence encoding a fusion protein comprising a nucleic acid programmable DNA binding protein (napDNAbp) and a nucleic acid editing domain operably linked to a first promoter; and (ii) an origin of replication, wherein the napDNAbp associates with an sgRNA under conditions that induce the expression of the fusion protein, and wherein the sgRNA is expressed by the eukaryotic cell.

In another aspect, provided herein is a writing plasmid for use in a eukaryotic cell comprising (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a sgRNA operably linked to a second promoter, wherein the sgRNA is complementary to a target sequence; and, optionally, (iii) an origin of replication, wherein at least one of the promoters is an inducible promoter, and wherein the sgRNA associates with the napDNAbp under conditions that induce the expression of the fusion protein and expression of the sgRNA.

In another aspect, provided herein is an integrated writing system in a eukaryotic cell comprising one or more loci present in the genome of the eukaryotic cell collectively comprising (i) a nucleic acid sequence encoding a fusion protein comprising a nucleic acid programmable DNA binding protein (napDNAbp) and a nucleic acid editing domain operably linked to a first promoter; and (ii) a nucleic acid sequence encoding a sgRNA operably linked to a second promoter, wherein the sgRNA is complementary to a target sequence, wherein at least one of the promoters is an inducible promoter, and wherein the sgRNA associates with the napDNAbp under conditions that induce the expression of the fusion protein and expression of the sgRNA.

In another aspect, provided herein are recording plasmids comprising (i) a target sequence complementary to a sgRNA, and (ii) an origin or replication.

In another aspect, provided herein is a cell data recorder system for use in prokaryotic cells comprising any of the writing plasmids described herein and one or more recording plasmids.

In another aspect, provided herein is a cell data recorder system for use in eukaryotic cells comprising any of the writing plasmids or the integrated writing systems provided herein and one or more recording loci, wherein each of the one or more recording loci comprises a target sequence complementary to an sgRNA expressed in the cell.

In another aspect, provided herein is a method for engineering a cell, the method comprising contacting the cell with one or more components of a cell data recorder system provided herein.

In another aspect, provided herein is a method for recording the presence/and or duration of one or more stimuli in a cell, the method comprising: (i) providing an engineered cell comprising the cell data recorder system; (ii) determining the percentage of base editing in a target sequence of a recording plasmid (R1); and (iii) comparing the percentage of base editing in the target sequence in the presence of the stimulus to the percentage of base editing in the absence of the stimulus.

In another aspect, provided herein is a method for recording the presence/and or duration of one or more stimuli in a cell, the method comprising: (i) providing an engineered cell comprising the cell data recorder system; (ii) determining an amount of the first recording plasmid (R1) and an amount of the second recording plasmid (R2) in the engineered cell; (iii) determining a ratio of the amount of the first recording plasmid (R1) and the amount of the second recording plasmid (R2); and (iv) comparing the ratio of R1 to R2 in the presence of the stimulus to the ratio of R1 to R2 in the absence of the stimulus.

The methods and compositions provided herein are useful in a wide variety of applications. For example, in certain embodiments, synthetic bacteria strains comprising a recording system provided herein can be used to monitor the gut microbiome by recording gut conditions with clinical implications. In other embodiments, engineered T cells comprising a recording system provided herein can be used to make treatment decisions by sensing disease indicators and becoming activated in the presence of, for example, inflammation or cancer.

In another aspect, provided herein is a method for recording the presence/and or duration of a stimulus, the method comprising: (i) providing an engineered cell comprising the cell data recorder system; (ii) determining the percentage of base editing in a target sequence of a recording locus; and (iii) comparing the percentage of base editing in the target sequence in the presence of the stimulus to the percentage of base editing in the absence of the stimulus.

Also provided herein are engineered cells comprising a writing plasmid, a recording plasmid, and/or one or more additional plasmids (e.g., accessory plasmids) provided herein. In some embodiments, the one or more components are transfected into the cells.

Also provided herein are kits comprising a writing plasmid, a recording plasmid, and/or one or more additional plasmids (e.g., accessory plasmids) provided herein.

The details of one or more embodiments of the invention are set forth in the Detailed Description of Certain Embodiments, as described below. Other features, objects, and advantages of the invention will be apparent from the Definitions, Examples, and Claims.

BRIEF DESCRIPTION OF THE DRAWINGS

The accompanying drawings, which constitute a part of this specification, illustrate several embodiments of the invention and together with the description, serve to explain the principles of the invention.

FIG. 1A shows a schematic representation of CAMERA 1 systems. Recording plasmids R1 and R2 are identical except a 3-nucleotide coding mutation in the EGFP gene (SEQ ID Nos. 620 and 621, respectively). The expression of the Cas9:sgRNA complex is controlled by the signal of interest and results in R1 depletion in the bacteria that carry the recording plasmid pair. FIG. 1B shows the stability of the R1:R2 ratio in E. coli S1030 cells in the absence of the writing plasmid. FIG. 1C shows in vitro cleavage of the wild-type and mutated EGFP gene by Cas9 in the presence of sgRNA1. The designed spacer sequence targets the distinct region in EGFP so the Cas9:sgRNA complex cleaves R1 much faster than R2. FIG. 1D shows the recording amplitude and duration of anhydrotetracycline (aTc) by CAMERA 1.0. The values and error bars reflect the mean R1 percentage and the standard deviation (s.d.) of replicates of three individual cultures originated from a single bacterial colony.

FIG. 2A shows the construction of an "AND" Boolean logic gate using CAMERA 1.1. Both IPTG and aTc are required for initiation of the recording process. FIG. 2B shows an analog recording of IPTG concentration by CAMERA 1.1 as reported by EGFP fluorescence. FIG. 2C shows repeated recording and erasing of CAMERA 1.2 by application of aTc and IPTG and kanamycin. FIG. 2D shows repeated recording and erasing of CAMERA 1.3 by inducing different writing complexes. FIG. 2E shows dose-dependent recording and erasing using CAMERA 1.3. Values and error bars reflect mean EGFP fluorescence or R3 content. The s.d. is calculated from three replicates.

FIG. 3A shows a schematic representation of CAMERA 2 systems. The writing plasmid expresses the writing complex consisting of BE2 and sgRNAs. The recording plasmid is targeted by the writing complex and generates memory in the form of C·G to T·A substitutions at guide RNA-specified loci (SEQ ID Nos. 620 and 622, respectively). FIG. 3B shows the recording of the concentration of aTc and the treatment duration in analog mode using CAMERA 2.0. FIG. 3C shows the recording of the concentration of IPTG in the presence or absence of aTc and the treatment duration in analog mode using CAMERA 2.1. FIG. 3D shows the rate of base editing at position 166 of the EGFP gene in CAMERA 2.0 reflects the schedule of exposure to the inducer. FIG. 3E shows that CAMERA 2.1 records the total time of exposure to IPTG, regardless of treatment pattern. FIG. 3F shows the recording of four exogenous stimuli using CAMERA 2.4. The presence of each signal, individually or in combinations, was recorded by base editing at each of several specified positions in the EGFP gene. The values and error bars reflect mean editing frequency and s.d. of three replicates.

FIG. 4A shows a schematic representation of CAMERA 2.5 that records stimuli in an order-dependent manner, depicting editing at positions 129 (SEQ ID NO. 864) and positions 205-207 and 216 (SEQ ID NO. 865). FIG. 4B shows that CAMERA 2.6 records the presence of arabinose at position 205-207 in the format of C·G to T·A mutations.

FIG. 4C shows that the ratio of base editing at position 216:129 in CAMERA 2.5 indicates the order of exposure to two stimuli. A position 216:129 base editing ratio above 0.1 was only observed when the bacteria were treated first with arabinose and then with rhamnose, but not if arabinose exposure follows rhamnose exposure. FIG. 4D shows phage infection recording by CAMERA 2.6. FIG. 4E shows the light exposure recording with CAMERA 2.7 in bulk culture and in small numbers of cells. Light exposure duration can be recorded faithfully in bulk culture as well as in samples of only 100 or 10 cells. Values and error bars in bar graphs reflect mean editing and the s.d. of three replicates. The dots and error bars in dot plots in FIG. 4E represent the mean and s.d. of 15 replicates of randomly sorted sets of 100 or 10 cells.

FIG. 5A shows a schematic representation of CAMERA 2m in mammalian cells. FIG. 5B shows that CAMERA 2 m.0 functions in a multiplexed manner in mammalian cells by targeting the human safe harbor gene CCR5. FIG. 5C shows that CAMERA 2 m.1 records the presence of doxycycline in HEK293T cells through a doxycycline-controlled transcriptional activator. FIG. 5D shows that CAMERA 2 m.2 records the presence of doxycycline and IPTG in a multiplexed manner. Expression of sgRNA A and sgRNA B is repressed by LacI and TetR in the absence of stimuli and can be turned on at the addition of IPTG and doxycycline, respectively. FIG. 5E shows that CAMERA 2 m.3 responds to Wnt signaling and records the presence of a Wnt signaling stimulus at a target genomic safe harbor locus. The values and error bars reflect mean editing and the s.d. of three replicates.

FIGS. 11A-11C depict the recording of the amplitude and duration of exogenous signals using CAMERAs 2.2 and 2.3. FIG. 11A shows that the behavior of CAMERA 2.2 mimics an "AND" Boolean logic gate. Both aTc and arabinose are required to turn the memory device on.

FIG. 11B shows an "AND" Boolean logic gate constructed using CAMERA 2.3. Both aTc and rhamnose are required to initiate the recording process. FIG. 11C shows that base editing accumulated at position 195 of the EGFP gene in CAMERA 2.3 is correlated with the concentration of rhamnose when aTc is supplied constantly. The values and error bars reflect mean editing and the s.d. of three replicates.

DEFINITIONS

Figure 1A:
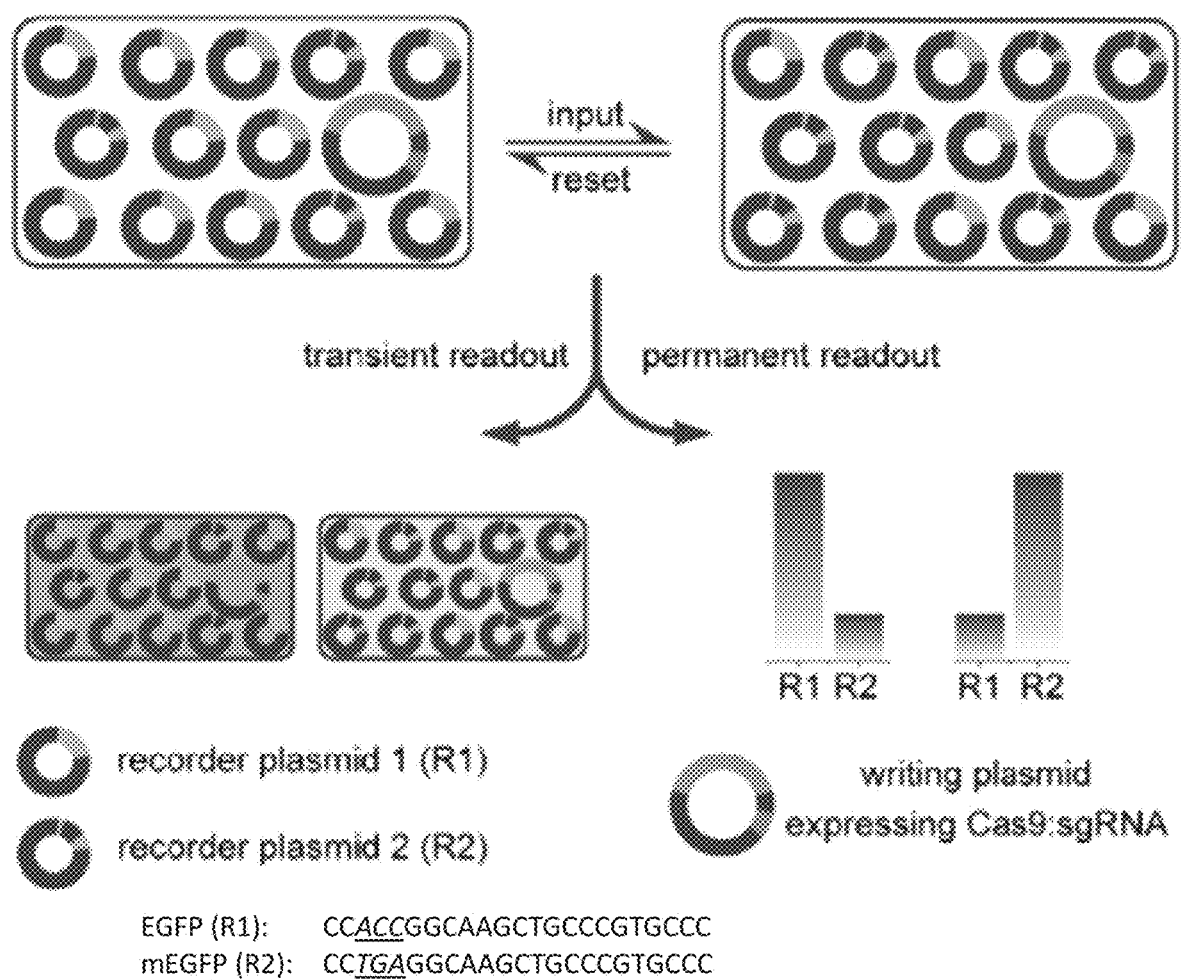
FIGS. 1A-1D depict plasmid ratios controlled by Cas9 nuclease in CAMERA 1.

As used herein and in the claims, the singular forms "a," "an," and "the" include the singular and the plural reference unless the context clearly indicates otherwise. Thus, for example, a reference to "an agent" includes a single agent and a plurality of such agents.

The term "base editor (BE)," or "nucleobase editor (NBE)," as used herein, refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating a cytosine (C) in DNA. In some embodiments, the base editor is a fusion protein comprising a nucleic acid programmable DNA binding protein fused to a nucleic acid editing domain. In some embodiments, the base editor is a fusion protein comprising a nucleic acid programmable DNA binding protein (napDNAbp) fused to a cytidine deaminase domain. In some embodiments, the base editor comprises a Cas9 domain (e.g., dCas9 or Cas9n), CasX, CasY, Cpf1, C2c1, C2c2, C2c3, or Argonaute protein fused to a cytidine deaminase. In some embodiments, the base editor comprises a Cas9 nickase (Cas9n) fused to an cytidine deaminase domain. In some embodiments, the base editor comprises a nuclease-inactive Cas9 (dCas9) fused to a cytidine deaminase domain. In some embodiments, the base editor is fused to an inhibitor of base excision repair, for example, a UGI domain, or a dISN domain. In some embodiments, the base editor comprises a CasX protein fused to a cytidine deaminase domain. In some embodiments, the base editor comprises a CasY protein fused to a cytidine deaminase domain. In some embodiments, the base editor comprises a Cpf1 protein fused to a cytidine deaminase domain. In some embodiments, the base editor comprises a C2c1 protein fused to a cytidine deaminase domain. In some embodiments, the base editor comprises a C2c2 protein fused to a cytidine deaminase domain. In some embodiments, the base editor comprises a C2c3 protein fused to a cytidine deaminase domain. In some embodiments, the base editor comprises an Argonaute protein fused to a cytidine deaminase domain. Base editors have been described, e.g., in Patent Publication No. WO2017/070632, published Apr. 27, 2017, entitled "Nucleobase Editors and Uses Thereof", in Patent Publication No. WO2018/027078, published Feb. 8, 2018, entitled "Adenosine Base Editors and Uses Thereof", in Patent Publication No. WO2018/165629, published Sep. 13, 2018, entitled "Cytosine to Guanine Base Editor", and in Patent Publication No. WO2018/176009, published Sep. 27, 2018, entitled "Nucleobase Editors Comprising Nucleic Acid Programmable DNA Binding Proteins"; the entire contents of each of which are incorporated by reference herein.

In some embodiments, the base editor is capable of deaminating an adenosine (A) in DNA. In some embodiments, the base editor is a fusion protein comprising a nucleic acid programmable DNA binding protein fused to a nucleic acid editing domain. In some embodiments, the base editor is a fusion protein comprising a nucleic acid programmable DNA binding protein (napDNAbp) fused to an adenosine deaminase domain. In some embodiments, the base editor is a fusion protein comprising a nucleic acid programmable DNA binding protein (napDNAbp) fused to one or more adenosine deaminase domains. In some embodiments, the base editor is a fusion protein comprising a nucleic acid programmable DNA binding protein (napD-NAbp) fused to two adenosine deaminase domains. In some embodiments, the base editor comprises a Cas9 (e.g., dCas9 and Cas9n), CasX, CasY, Cpf1, C2c1, C2c2, C2c3, or Argonaute protein fused to an adenosine deaminase domain. In some embodiments, the base editor comprises a Cas9 nickase (Cas9n) fused to an adenosine deaminase domain. In some embodiments, the base editor comprises a Cas9 nickase (Cas9n) fused to two adenosine deaminase domains. In some embodiments, the base editor comprises a nuclease-inactive Cas9 (dCas9) fused to an adenosine deaminase domain. In some embodiments, the base editor comprises a nuclease-inactive Cas9 (dCas9) fused to two adenosine deaminase domains. In some embodiments, the base editor is fused to an inhibitor of base excision repair, for example, a UGI domain, or a dISN domain. In some embodiments, the base editor comprises a CasX protein fused to one or more adenosine deaminase domains. In some embodiments, the base editor comprises a CasY protein fused to one or more adenosine deaminase domains. In some embodiments, the base editor comprises a Cpf1 protein fused to one or more adenosine deaminase domains. In some embodiments, the base editor comprises a C2c1 protein fused to one or more adenosine deaminase domains. In some embodiments, the base editor comprises a C2c2 protein fused to one or more adenosine deaminase domains. In some embodiments, the base editor comprises a C2c3 protein fused to one or more adenosine deaminase domains. In some embodiments, the base editor comprises an Argonaute protein fused to one or more adenosine deaminase domains.

The term "nucleic acid programmable DNA binding protein" or "napDNAbp" refers to a protein that associates with a nucleic acid (e.g., DNA or RNA), such as a guide nucleic acid (e.g., gRNA), that guides the napDNAbp to a specific nucleic acid sequence, for example, by hybridizing to the target nucleic acid sequence. For example, a Cas9 protein can associate with a guide RNA that guides the Cas9 protein to a specific DNA sequence is has complementary to the guide RNA. In some embodiments, the napDNAbp is a class 2 microbial CRISPR-Cas effector. In some embodiments, the napDNAbp is a Cas9 domain, for example, a nuclease active Cas9, a Cas9 nickase (Cas9n), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. It should be appreciated, however, that nucleic acid programmable DNA binding proteins also include nucleic acid programmable proteins that bind RNA. For example, the napDNAbp may be associated with a nucleic acid that guides the napDNAbp to an RNA. Other nucleic acid programmable DNA binding proteins are also within the scope of this disclosure, though they may not be specifically described in this disclosure.

In some embodiments, the napDNAbp is an "RNA-programmable nuclease" or "RNA-guided nuclease." The terms are used interchangeably herein and refer to a nuclease that forms a complex with (e.g., binds or associates with) one or more RNA(s) that is not a target for cleavage. In some embodiments, an RNA-programmable nuclease, when in a complex with an RNA, may be referred to as a nuclease: RNA complex. Typically, the bound RNA(s) is referred to as a guide RNA (gRNA). Guide RNAs can exist as a complex of two or more RNAs, or as a single RNA molecule. Guide RNAs that exist as a single RNA molecule may be referred to as single-guide RNAs (sgRNAs), though "gRNA" is also used to refer to guide RNAs that exist as either single molecules or as a complex of two or more molecules.

Typically, gRNAs that exist as a single RNA species comprise two domains: (1) a domain that shares homology to a target nucleic acid (i.e., directs binding of a Cas9 complex to the target); and (2) a domain that binds a Cas9 protein. In some embodiments, domain (2) corresponds to a sequence known as a tracrRNA and comprises a stem-loop structure. In some embodiments, domain (2) is identical or homologous to a tracrRNA as provided in Jinek et al., *Science* 337:816-821 (2012), the entire contents of which is incorporated herein by reference. Other examples of gRNAs (e.g., those including domain 2) can be found in International Patent Application PCT/US2014/054252, filed Sep. 5, 2014, published as Patent Publication No. WO2015/035139, published Mar. 12, 2015, entitled "Switchable Cas9 Nucleases And Uses Thereof," and International Patent Application PCT/US2014/054247, filed Sep. 5, 2014, published as Patent Publication No. WO2015/035136, published Mar. 12, 2015, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (also known as Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., Mclaughlin R. E., *Proc. Natl. Acad. Sci. U.S.A.* 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., *Nature* 471:602-607 (2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821 (2012), the entire contents of each of which are incorporated herein by reference).

Because RNA-programmable nucleases (e.g., Cas9) use RNA:DNA hybridization to target DNA cleavage sites, these proteins are able to target, in principle, any sequence specified by the guide RNA. Methods of using RNA-programmable nucleases, such as Cas9, for site-specific cleavage (e.g., to modify a genome) are known in the art (see e.g., Cong et al., Multiplex genome engineering using CRISPR/Cas systems. *Science* 339, 819-823 (2013); Mali, P. et al., RNA-guided human genome engineering via Cas9. *Science* 339, 823-826 (2013); Hwang, W. Y. et al., Efficient genome editing in zebrafish using a CRISPR-Cas system. *Nature biotechnology* 31, 227-229 (2013); Jinek, M. et al. RNA-programmed genome editing in human cells. *eLife* 2, e00471 (2013); Dicarlo, J. E. et al., Genome engineering in *Saccharomyces cerevisiae* using CRISPR-Cas systems. *Nucleic Acids Research* (2013); Jiang, W. et al., RNA-guided editing of bacterial genomes using CRISPR-Cas systems. *Nature Biotechnology* 31, 233-239 (2013); the entire contents of each of which are incorporated herein by reference).

The term "Cas9" or "Cas9 nuclease" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease may also be referred to as a casn1 nuclease or a CRISPR (Clustered Regularly Interspaced Short Palindromic Repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, the Cas9/crRNA/tracrRNA complex endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species (see, e.g., Jinek M., Chylinski K., Fonfara I., Hauer M., Doudna J. A., Charpentier E. *Science* 337:816-821(2012), the entire contents of which is hereby incorporated by reference). Cas9 recognizes a short motif in the CRISPR repeat sequences (the PAM or protospacer adjacent motif) to help distinguish self versus non-self. Cas9 nuclease sequences and structures are well known to those of ordinary skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., Mclaughlin R. E., *Proc. Natl. Acad. Sci. U.S.A.* 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes S. thermophiles, Geobacillus stearothermophilus, Corynebacterium ulcerans, Corynebacterium diphtheria, Spiroplasma syrphidicola, Prevotella intermedia, Spiroplasma taiwanense, Streptococcus iniae, Belliella baltica, Psychroflexus torquisl, Listeria innocua, Campylobacter jejuni*, or *Neisseria meningitidis*. In some embodiments, the Cas9 ortholog is an saCas9 domain, an spCas9 domain comprising one or more mutations to alter the PAM specificity, or a Cpf1 domain. Additional suitable Cas9 nucleases and sequences will be apparent to those of ordinary skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease comprises one or more mutations that inactive the DNA cleavage domain, that is, the Cas9 is a nickase and/or a nuclease-inactivated Cas9 protein.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (see, e.g., Jinek et al., *Science*. 337:816-821(2012); Qi et al., "Repurposing CRISPR as an RNA-Guided Platform for Sequence-Specific Control of Gene Expression" (2013) *Cell*. 28; 152(5): 1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5): 1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, at least about 99.8% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild type Cas9 corresponds to Cas9 from *Streptococcus pyogenes* (NCBI Reference Sequence: NC_017053.1, SEQ ID NO:1 (nucleotide); SEQ ID NO:2 (amino acid)).

(SEQ ID NO: 1)
ATGGATAAGAAATACTCAATAGGCTTAGATATCGGCACAAATAGCGTCGGATGGGCGGTGATCACTGATGATTA

TAAGGTTCCGTCTAAAAAGTTCAAGGTTCTGGGAAATACAGACCGCCACAGTATCAAAAAAAATCTTATAGGGG

CTCTTTTATTTGGCAGTGGAGAGACAGCGGAAGCGACTCGTCTCAAACGGACAGCTCGTAGAAGGTATACACGT

CGGAAGAATCGTATTTGTTATCTACAGGAGATTTTTTCAAATGAGATGGCGAAAGTAGATGATAGTTTCTTTCA

TCGACTTGAAGAGTCTTTTTTGGTGGAAGAAGACAAGAAGCATGAACGTCATCCTATTTTTGGAAATATAGTAG

ATGAAGTTGCTTATCATGAGAAATATCCAACTATCTATCATCTGCGAAAAAAATTGGCAGATTCTACTGATAAA

GCGGATTTGCGCTTAATCTATTTGGCCTTAGCGCATATGATTAAGTTTCGTGGTCATTTTTTGATTGAGGGAGA

TTTAAATCCTGATAATAGTGATGTGGACAAACTATTTATCCAGTTGGTACAAATCTACAATCAATTATTTGAAG

AAAACCCTATTAACGCAAGTAGAGTAGATGCTAAAGCGATTCTTTCTGCACGATTGAGTAAATCAAGACGATTA

GAAAATCTCATTGCTCAGCTCCCCGGTGAGAAGAGAAATGGCTTGTTTGGGAATCTCATTGCTTTGTCATTGGG

ATTGACCCCTAATTTTAAATCAAATTTTGATTTGGCAGAAGATGCTAAATTACAGCTTTCAAAAGATACTTACG

ATGATGATTTAGATAATTTATTGGCGCAAATTGGAGATCAATATGCTGATTTGTTTTTGGCAGCTAAGAATTTA

TCAGATGCTATTTTACTTTCAGATATCCTAAGAGTAAATAGTGAAATAACTAAGGCTCCCCTATCAGCTTCAAT

GATTAAGCGCTACGATGAACATCATCAAGACTTGACTCTTTTAAAAGCTTTAGTTCGACAACAACTTCCAGAAA

AGTATAAAGAAATCTTTTTTGATCAATCAAAAAACGGATATGCAGGTTATATTGATGGGGAGCTAGCCAAGAA

GAATTTATAAATTTATCAAACCAATTTTAGAAAAAATGGATGGTACTGAGGAATTATTGGTGAAACTAAATCG

TGAAGATTTGCTGCGCAAGCAACGGACCTTTGACAACGGCTCTATTCCCCATCAAATTCACTTGGGTGAGCTGC

ATGCTATTTTGAGAAGACAAGAAGACTTTTATCCATTTTTAAAAGACAATCGTGAGAAGATTGAAAAAATCTTG

ACTTTTCGAATTCCTTATTATGTTGGTCCATTGGCGCGTGGCAATAGTCGTTTTGCATGGATGACTCGGAAGTC

TGAAGAAACAATTACCCCATGGAATTTTGAAGAAGTTGTCGATAAAGGTGCTTCAGCTCAATCATTTATTGAAC

GCATGACAAACTTTGATAAAAATCTTCCAAATGAAAAGTACTACCAAAACATAGTTTGCTTTATGAGTATTTT

ACGGTTTATAACGAATTGACAAAGGTCAAATATGTTACTGAGGGAATGCGAAAACCAGCATTTCTTTCAGGTGA

ACAGAAGAAAGCCATTGTTGATTTACTCTTCAAAACAAATCGAAAAGTAACCGTTAAGCAATTAAAAGAAGATT

ATTTCAAAAAAATAGAATGTTTTGATAGTGTTGAAATTTCAGGAGTTGAAGATAGATTTAATGCTTCATTAGGC

GCCTACCATGATTTGCTAAAAATTATTAAAGATAAAGATTTTTTGGATAATGAAGAAATGAAGATATCTTAGA

GGATATTGTTTTAACATTGACCTTATTTGAAGATAGGGGATGATTGAGGAAAGACTTAAAACATATGCTCACC

TCTTTGATGATAAGGTGATGAAACAGCTTAAACGTCGCCGTTATACTGGTTGGGACGTTTGTCTCGAAAATTG

ATTAATGGTATTAGGGATAAGCAATCTGGCAAAACAATATTAGATTTTTTGAAATCAGATGGTTTTGCCAATCG

CAATTTTATGCAGCTGATCCATGATGATAGTTTGACATTTAAAGAAGATATTCAAAAAGCACAGGTGTCTGGAC

AAGGCCATAGTTTACATGAACAGATTGCTAACTTAGCTGGCAGTCCTGCTATTAAAAAAGGTATTTTACAGACT

GTAAAAATTGTTGATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAGGTATCAAAGAAT

TAGGAAGTCAGATTCTTAAAGAGCATCCTGTTGAAAATACTCAATTGCAAAATGAAAAGCTCTATCTCTATTAT

CTACAAAATGGAAGAGACATGTATGTGGACCAAGAATTAGATATTAATCGTTTAAGTGATTATGATGTCGATCA

CATTGTTCCACAAAGTTTCATTAAAGACGATTCAATAGACAATAAGGTACTAACGCGTTCTGATAAAAATCGTG

GTAAATCGGATAACGTTCCAAGTGAAGAAGTAGTCAAAAAGATGAAAAACTATTGGAGACAACTTCTAAACGCC

AAGTTAATCACTCAACGTAAGTTTGATAATTTAACGAAAGCTGAACGTGGAGGTTTGAGTGAACTTGATAAAGC

TGGTTTTATCAAACGCCAATTGGTTGAAACTCGCCAAATCACTAAGCATGTGGCACAAATTTTGGATAGTCGCA

TGAATACTAAATACGATGAAAATGATAAACTTATTCGAGAGGTTAAAGTGATTACCTTAAAATCTAAATTAGTT

TCTGACTTCCGAAAAGATTTCCAATTCTATAAAGTACGTGAGATTAACAATTACCATCATGCCCATGATGCGTA

-continued

```
TCTAAATGCCGTCGTTGGAACTGCTTTGATTAAGAAATATCCAAAACTTGAATCGGAGTTTGTCTATGGTGATT

ATAAAGTTTATGATGTTCGTAAAATGATTGCTAAGTCTGAGCAAGAAATAGGCAAAGCAACCGCAAAATATTTC

TTTTACTCTAATATCATGAACTTCTTCAAAACAGAAATTACACTTGCAAATGGAGAGATTCGCAAACGCCCTCT

AATCGAAACTAATGGGGAAACTGGAGAAATTGTCTGGGATAAAGGGCGAGATTTTGCCACAGTGCGCAAAGTAT

TGTCCATGCCCCAAGTCAATATTGTCAAGAAAACAGAAGTACAGACAGGCGGATTCTCCAAGGAGTCAATTTTA

CCAAAAAGAAATTCGGACAAGCTTATTGCTCGTAAAAAGACTGGGATCCAAAAAAATATGGTGGTTTTGATAG

TCCAACGGTAGCTTATTCAGTCCTAGTGGTTGCTAAGGTGGAAAAAGGGAAATCGAAGAAGTTAAAATCCGTTA

AAGAGTTACTAGGGATCACAATTATGGAAAGAAGTTCCTTTGAAAAAAATCCGATTGACTTTTTAGAAGCTAAA

GGATATAAGGAAGTTAAAAAAGACTTAATCATTAAACTACCTAAATATAGTCTTTTTGAGTTAGAAAACGGTCG

TAAACGGATGCTGGCTAGTGCCGGAGAATTACAAAAAGGAAATGAGCTGGCTCTGCCAAGCAAATATGTGAATT

TTTTATATTTAGCTAGTCATTATGAAAGTTGAAGGGTAGTCCAGAAGATAACGAACAAAAACAATTGTTTGTG

GAGCAGCATAAGCATTATTTAGATGAGATTATTGAGCAAATCAGTGAATTTTCTAAGCGTGTTATTTTAGCAGA

TGCCAATTTAGATAAAGTTCTTAGTGCATATAACAAACATAGAGACAAACCAATACGTGAACAAGCAGAAAATA

TTATTCATTTATTTACGTTGACGAATCTTGGAGCTCCCGCTGCTTTTAAATATTTTGATACAACAATTGATCGT

AAACGATATACGTCTACAAAAGAAGTTTTAGATGCCACTCTTATCCATCAATCCATCACTGGTCTTTATGAAAC

ACGCATTGATTTGAGTCAGCTAGGAGGTGACTGA
```

(SEQ ID NO: 2)
MDKK<u>YSIGLDIGTNSVGWAVITDDYKVPSKKFKVLGNTDRHSIKKNLIGALLFGSGETA</u>EATRLKRTARRRYTR

RKNRICYLQEIFSNEMAKVDDSFFHRLEESFLVEEDKKHERHPIFGNIVDEVAYHEKYPTIYHLRKKLADSTDK

ADLRLIYLALAHMIKFRGHFLIEGDLNPDNSDVDKLFIQLVQIYNQLFEENPINASRVDAKAILSARLSKSRRL

ENLIAQLPGEKRNGLFGNLIALSLGLTPNFKSNFDLAEDAKLQLSKDTYDDDLDNLLAQIGDQYADLFLAAKNL

SDAILLSDILRVNSEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNFDKNLPNEKVLPKHSLLYEYF

TVYNELTKVKYVTEGMRKPAFLSGEQKKAIVDLLFKTNRKVTVKQLKEDYFKKIECFDSVEISGVEDRFNASLG

AYHDLLKIIKDKDFLDNEENEDILEDIVLTLTLFEDRGMIEERLKTYAHLFDDKVMKQLKRRRYTGWGRLSRKL

INGIRDKQSGKTILDFLKSDGFANRNFMQLIHDDSLTFKEDIQKAQVSGQG<u>HSLHEQIANLAGSPAIKKGILQT

VKIVDELVKVMGHKPENIVIEMARE</u>NQTTQKGQKNSRERMKRIEEGIKELGSQILKEHPVENTQLQNEKLYLYY

LQNGRDMYVDQELDINRLSDYDVDHIVPQSFIKDDSIDNKVLTRSDKNRGKSDNVPSEEVVKKMKNYWRQLLNA

KLITQRKFDNLTKAERG<u>GLSELDKAGFIKRQLVETRQITKHVAQILDSRMNIKYDENDKLIREVKVITLKSKLV

SDFRKDFQFYKVREINNYHHAHDAYLNAVVGTALIKKYPKLESEFVYGDYKVYDVRKMIAKSEQEIGKATAKYF

FYSNIMNFFKTEITLANGEIRKRPLIETNGETGEIVWDKGRDFATVRKVLSMPQVNIVKKTEVQT</u>GGFSKESIL

PKRNSDKLIARKKDWDPKKYGGFDSPTVAYSVLVVAKVEKGKSKKLKSVKELLGITIMERSSFEKNPIDFLEAK

-continued

```
GYKEVKKDLIIKLPKYSLFELENGRKRMLASAGELQKGNELALPSKYVNFLYLASHYEKLKGSPEDNEQKQLFV

EQHKHYLDEIIEQISEFSKRVILADANLDKVLSAYNKHRDKPIREQAENIIHLFTLTNLGAPAAFKYFDTTIDR

KRYTSTKEVLDATLIHQSITGLYETRIDLSQLGGD
(single underline: HNH domain; double underline: RuvC domain)
```

In some embodiments, wild type Cas9 corresponds to, or comprises SEQ ID NO:3 (nucleotide) and/or SEQ ID NO: 4 (amino acid):

```
                                                             (SEQ ID NO: 3)
ATGGATAAAAAGTATTCTATTGGTTTAGACATCGGCACTAATTCCGTTGGATGGGCTGTCATAACCGATGAATA

CAAAGTACCTTCAAAGAAATTTAAGGTGTTGGGGAACACAGACCGTCATTCGATTAAAAAGAATCTTATCGGTG

CCCTCCTATTCGATAGTGGCGAAACGGCAGAGGCGACTCGCCTGAAACGAACCGCTCGGAGAAGGTATACACGT

CGCAAGAACCGAATATGTTACTTACAAGAAATTTTTAGCAATGAGATGGCCAAAGTTGACGATTCTTTCTTTCA

CCGTTTGGAAGAGTCCTTCCTTGTCGAAGAGGACAAGAAACATGAACGGCACCCCATCTTTGGAAACATAGTAG

ATGAGGTGGCATATCATGAAAAGTACCCAACGATTTATCACCTCAGAAAAAAGCTAGTTGACTCAACTGATAAA

GCGGACCTGAGGTTAATCTACTTGGCTCTTGCCCATATGATAAAGTTCCGTGGGCACTTTCTCATTGAGGGTGA

TCTAAATCCGGACAACTCGGATGTCGACAAACTGTTCATCCAGTTAGTACAAACCTATAATCAGTTGTTTGAAG

AGAACCCTATAAATGCAAGTGGCGTGGATGCGAAGGCTATTCTTAGCGCCCGCCTCTCTAAATCCCGACGGCTA

GAAAACCTGATCGCACAATTACCCGGAGAGAAGAAAAATGGGTTGTTCGGTAACCTTATAGCGCTCTCACTAGG

CCTGACACCAAATTTTAAGTCGAACTTCGACTTAGCTGAAGATGCCAAATTGCAGCTTAGTAAGGACACGTACG

ATGACGATCTCGACAATCTACTGGCACAAATTGGAGATCAGTATGCGGACTTATTTTTGGCTGCCAAAAACCTT

AGCGATGCAATCCTCCTATCTGACATACTGAGAGTTAATACTGAGATTACCAAGGCGCCGTTATCCGCTTCAAT

GATCAAAAGGTACGATGAACATCACCAAGACTTGACACTTCTCAAGGCCCTAGTCCGTCAGCAACTGCCTGAGA

AATATAAGGAAATATTCTTTGATCAGTCGAAAAACGGGTACGCAGGTTATATTGACGGCGGAGCGAGTCAAGAG

GAATTCTACAAGTTTATCAAACCCATATTAGAGAAGATGGATGGGACGGAAGAGTTGCTTGTAAAACTCAATCG

CGAAGATCTACTGCGAAAGCAGCGGACTTTCGACAACGGTAGCATTCCACATCAAATCCACTTAGGCGAATTGC

ATGCTATACTTAGAAGGCAGGAGGATTTTTATCCGTTCCTCAAAGACAATCGTGAAAGATTGAGAAAATCCTA

ACCTTTCGCATACCTTACTATGTGGGACCCCTGGCCCGAGGGAACTCTCGGTTCGCATGGATGACAAGAAAGTC

CGAAGAAACGATTACTCCATGGAATTTTGAGGAAGTTGTCGATAAAGGTGCGTCAGCTCAATCGTTCATCGAGA

GGATGACCAACTTTGACAAGAATTTACCGAACGAAAAGTATTGCCTAAGCACAGTTTACTTTACGAGTATTTC

ACAGTGTACAATGAACTCACGAAAGTTAAGTATGTCACTGAGGGCATGCGTAAACCCGCCTTTCTAAGCGGAGA

ACAGAAGAAAGCAATAGTAGATCTGTTATTCAAGACCAACCGCAAAGTGACAGTTAAGCAATTGAAAGAGGACT

ACTTTAAGAAAATTGAATGCTTCGATTCTGTCGAGATCTCCGGGGTAGAAGATCGATTTAATGCGTCACTTGGT

ACGTATCATGACCTCCTAAAGATAATTAAAGATAAGGACTTCCTGGATAACGAAGAGAATGAAGATATCTTAGA

AGATATAGTGTTGACTCTTACCCTCTTTGAAGATCGGGAAATGATTGAGGAAAGACTAAAAACATACGCTCACC

TGTTCGACGATAAGGTTATGAAACAGTTAAAGAGGCGTCGCTATACGGGCTGGGACGATTGTCGCGGAAACTT

ATCAACGGGATAAGAGACAAGCAAAGTGGTAAAACTATTCTCGATTTTCTAAAGAGCGACGGCTTCGCCAATAG

GAACTTTATGCAGCTGATCCATGATGACTCTTTAACCTTCAAAGAGGATATACAAAAGGCACAGGTTTCCGGAC

AAGGGGACTCATTGCACGAACATATTGCGAATCTTGCTGGTTCGCCAGCCATCAAAAAGGGCATACTCCAGACA

GTCAAAGTAGTGGATGAGCTAGTTAAGGTCATGGGACGTCACAAACCGGAAAACATTGTAATCGAGATGGCACG

CGAAAATCAAACGACTCAGAAGGGGCAAAAAAACAGTCGAGAGCGGATGAAGAGAATAGAAGAGGGTATTAAAG

AACTGGGCAGCCAGATCTTAAAGGAGCATCCTGTGGAAAATACCCAATTGCAGAACGAGAAACTTTACCTCTAT
```

-continued

```
TACCTACAAAATGGAAGGGACATGTATGTTGATCAGGAACTGGACATAAACCGTTTATCTGATTACGACGTCGA

TCACATTGTACCCCAATCCTTTTTGAAGGACGATTCAATCGACAATAAAGTGCTTACACGCTCGGATAAGAACC

GAGGGAAAAGTGACAATGTTCCAAGCGAGGAAGTCGTAAAGAAAATGAAGAACTATTGGCGGCAGCTCCTAAAT

GCGAAACTGATAACGCAAAGAAAGTTCGATAACTTAACTAAAGCTGAGAGGGGTGGCTTGTCTGAACTTGACAA

GGCCGGATTTATTAAACGTCAGCTCGTGGAAACCCGCCAAATCACAAAGCATGTTGCACAGATACTAGATTCCC

GAATGAATACGAAATACGACGAGAACGATAAGCTGATTCGGGAAGTCAAAGTAATCACTTTAAAGTCAAAATTG

GTGTCGGACTTCAGAAAGGATTTTCAATTCTATAAAGTTAGGGAGATAAATAACTACCACCATGCGCACGACGC

TTATCTTAATGCCGTCGTAGGGACCGCACTCATTAAGAAATACCCGAAGCTAGAAAGTGAGTTTGTGTATGGTG

ATTACAAAGTTTATGACGTCCGTAAGATGATCGCGAAAAGCGAACAGGAGATAGGCAAGGCTACAGCCAAATAC

TTCTTTTATTCTAACATTATGAATTTCTTTAAGACGGAAATCACTCTGGCAAACGGAGAGATACGCAAACGACC

TTTAATTGAAACCAATGGGGAGACAGGTGAAATCGTATGGGATAAGGGCCGGGACTTCGCGACGGTGAGAAAAG

TTTTGTCCATGCCCCAAGTCAACATAGTAAAGAAAACTGAGGTGCAGACCGGAGGGTTTTCAAAGGAATCGATT

CTTCCAAAAAGGAATAGTGATAAGCTCATCGCTCGTAAAAAGGACTGGGACCCGAAAAAGTACGGTGGCTTCGA

TAGCCCTACAGTTGCCTATTCTGTCCTAGTAGTGGCAAAAGTTGAGAAGGGAAAATCCAAGAAACTGAAGTCAG

TCAAAGAATTATTGGGGATAACGATTATGGAGCGCTCGTCTTTTGAAAAGAACCCCATCGACTTCCTTGAGGCG

AAAGGTTACAAGGAAGTAAAAAAGGATCTCATAATTAAACTACCAAAGTATAGTCTGTTTGAGTTAGAAAATGG

CCGAAAACGGATGTTGGCTAGCGCCGGAGAGCTTCAAAAGGGGAACGAACTCGCACTACCGTCTAAATACGTGA

ATTTCCTGTATTTAGCGTCCCATTACGAGAAGTTGAAAGGTTCACCTGAAGATAACGAACAGAAGCAACTTTTT

GTTGAGCAGCACAAACATTATCTCGACGAAATCATAGAGCAAATTTCGGAATTCAGTAAGAGAGTCATCCTAGC

TGATGCCAATCTGGACAAAGTATTAAGCGCATACAACAAGCACAGGGATAAACCCATACGTGAGCAGGCGGAAA

ATATTATCCATTTGTTTACTCTTACCAACCTCGGCGCTCCAGCCGCATTCAAGTATTTTGACACAACGATAGAT

CGCAAACGATACACTTCTACCAAGGAGGTGCTAGACGCGACACTGATTCACCAATCCATCACGGGATTATATGA

AACTCGGATAGATTTGTCACAGCTTGGGGGTGACGGATCCCCCAAGAAGAAGAGGAAAGTCTCGAGCGACTACA

AAGACCATGACGGTGATTATAAAGATCATGACATCGATTACAAGGATGACGATGACAAGGCTGCAGGA
```

(SEQ ID NO: 4)
MDKK<u>YSIGLAIGTNSVGWAVITDEYKVPSKKFKVLGNTDRHSIKKNLIGALLFDSGET</u>AEATRLKRTARRRYTR

RKNRICYLQEIFSNEMAKVDDSFFHRLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNFDKNLPNEKVLPKHSLLYEYF

TVYNELTKVKYVTEGMRKPAFLSGEQKKAIVDLLFKTNRKVTVKQLKEDYFKKIECFDSVEISGVEDRFNASLG

TYHDLLKIIKDKDFLDNEENEDILEDIVLTLTLFEDREMIEERLKTYAHLFDDKVMKQLRRRYTGWGRLSRKL

INGIRDKQSGKTILDFLKSDGFANRNFMQLIHDDSLTFKEDIQKAQVSGQG<u>DSLHEHIANLAGSPAIKKGILQT

VKVVDELVKVMGRHKPENIVIEMARENQTTQKGQKNSRERMKRIEEGIKELGSQILKEHPVENTQLQNEKLYLY

YLQNGRDMYVDQELDINRLSDYDVDHIVPQSFLKDDSIDNKVLTRSDKNRGKSDNVPSEEVVKKMKNYWRQLLN

AKLITQRKFDNLTKAERGGLSELDKAGFIKRQLVETRQITKHVAQILDSRMNTKYDENDKLIREVKVITLKSKL

VSDFRKDFQFYKVREINNYHHAHDAYLNAVVGTALIKKYPKLESEFVYGDYKVYDVRKMIAKSEQEIGKATAKY

FFYSNIMNFFKTEITLANGEIRKRPLIETNGETGEIVWDKGRDFATVRKVLSMPQVNIVKKTEVQTGGFSKESI</u>

LPKRNSDKLIARKKDWDPKKYGGFDSPTVAYSVLVVAKVEKGKSKKLKSVKELLGITIMERSSFEKNPIDFLEA

```
KGYKEVKKDLIIKLPKYSLFELENGRKRMLASAGELQKGNELALPSKYVNFLYLASHYEKLKGSPEDNEQKQLF

VEQHKHYLDEIIEQISEFSKRVILADANLDKVLSAYNKHRDKPIREQAENIIHLFTLTNLGAPAAFKYFDTTID

RKRYTSTKEVLDATLIHQSITGLYETRIDLSQLGGD
(single underline: HNH domain; double underline: RuvC domain)
```

In some embodiments, wild type Cas9 corresponds to Cas9 from *Streptococcus pyogenes* (NCBI Reference Sequence: NC_002737.2, SEQ ID NO: 5 (nucleotide); and Uniprot Reference Sequence: Q99ZW2, SEQ ID NO: 10 (amino acid).

```
                                                                (SEQ ID NO: 5)
ATGGATAAGAAATACTCAATAGGCTTAGATATCGGCACAAATAGCGTCGGATGGGCGGTGATCACTGATGAATA

TAAGGTTCCGTCTAAAAAGTTCAAGGTTCTGGGAAATACAGACCGCCACAGTATCAAAAAAAATCTTATAGGGG

CTCTTTTATTTGACAGTGGAGAGACAGCGGAAGCGACTCGTCTCAAACGGACAGCTCGTAGAAGGTATACACGT

CGGAAGAATCGTATTTGTTATCTACAGGAGATTTTTTCAAATGAGATGGCGAAAGTAGATGATAGTTTCTTTCA

TCGACTTGAAGAGTCTTTTTTGGTGGAAGAAGACAAGAAGCATGAACGTCATCCTATTTTTGGAAATATAGTAG

ATGAAGTTGCTTATCATGAGAAATATCCAACTATCTATCATCTGCGAAAAAAATTGGTAGATTCTACTGATAAA

GCGGATTTGCGCTTAATCTATTTGGCCTTAGCGCATATGATTAAGTTTCGTGGTCATTTTTTGATTGAGGGAGA

TTTAAATCCTGATAATAGTGATGTGGACAAACTATTTATCCAGTTGGTACAAACCTACAATCAATTATTTGAAG

AAAACCCTATTAACGCAAGTGGAGTAGATGCTAAAGCGATTCTTTCTGCACGATTGAGTAAATCAAGACGATTA

GAAAATCTCATTGCTCAGCTCCCCGGTGAGAAGAAAAATGGCTTATTTGGGAATCTCATTGCTTTGTCATTGGG

TTTGACCCCTAATTTTAAATCAAATTTTGATTTGGCAGAAGATGCTAAATTACAGCTTTCAAAAGATACTTACG

ATGATGATTTAGATAATTTATTGGCGCAAATTGGAGATCAATATGCTGATTTGTTTTTGGCAGCTAAGAATTTA

TCAGATGCTATTTTACTTTCAGATATCCTAAGAGTAAATACTGAAATAACTAAGGCTCCCCTATCAGCTTCAAT

GATTAAACGCTACGATGAACATCATCAAGACTTGACTCTTTTAAAAGCTTTAGTTCGACAACAACTTCCAGAAA

AGTATAAAGAAATCTTTTTTGATCAATCAAAAAACGGATATGCAGGTTATATTGATGGGGGAGCTAGCCAAGAA

GAATTTTATAAATTTATCAAACCAATTTTAGAAAAAATGGATGGTACTGAGGAATTATTGGTGAAACTAAATCG

TGAAGATTTGCTGCGCAAGCAACGGACCTTTGACAACGGCTCTATTCCCCATCAAATTCACTTGGGTGAGCTGC

ATGCTATTTTGAGAAGACAAGAAGACTTTTATCCATTTTTAAAAGACAATCGTGAGAAGATTGAAAAAATCTTG

ACTTTTCGAATTCCTTATTATGTTGGTCCATTGGCGCGTGGCAATAGTCGTTTTGCATGGATGACTCGGAAGTC

TGAAGAAACAATTACCCCATGGAATTTTGAAGAAGTTGTCGATAAAGGTGCTTCAGCTCAATCATTTATTGAAC

GCATGACAAACTTTGATAAAAATCTTCCAAATGAAAAAGTACTACCAAAACATAGTTTGCTTTATGAGTATTTT

ACGGTTTATAACGAATTGACAAAGGTCAAATATGTTACTGAAGGAATGCGAAAACCAGCATTTCTTTCAGGTGA

ACAGAAGAAAGCCATTGTTGATTTACTCTTCAAAACAAATCGAAAAGTAACCGTTAAGCAATTAAAAGAAGATT

ATTTCAAAAAAATAGAATGTTTTGATAGTGTTGAAATTTCAGGAGTTGAAGATAGATTTAATGCTTCATTAGGT

ACCTACCATGATTTGCTAAAAATTATTAAAGATAAAGATTTTTTGGATAATGAAGAAAATGAAGATATCTTAGA

GGATATTGTTTTAACATTGACCTTATTTGAAGATAGGGAGATGATTGAGGAAAGACTTAAAACATATGCTCACC

TCTTTGATGATAAGGTGATGAAACAGCTTAAACGTCGCCGTTATACTGGTTGGGGACGTTTGTCTCGAAAATTG

ATTAATGGTATTAGGGATAAGCAATCTGGCAAAACAATATTAGATTTTTTGAAATCAGATGGTTTTGCCAATCG

CAATTTTATGCAGCTGATCCATGATGATAGTTTGACATTTAAAGAAGACATTCAAAAAGCACAAGTGTCGGAC

AAGGCGATAGTTTACATGAACATATTGCAAATTTAGCTGGTAGCCCTGCTATTAAAAAAGGTATTTTACAGACT

GTAAAAGTTGTTGATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAGAAGGTATCAAAG
```

```
AATTAGGAAGTCAGATTCTTAAAGAGCATCCTGTTGAAAATACTCAATTGCAAAATGAAAAGCTCTATCTCTAT

TATCTCCAAAATGGAAGAGACATGTATGTGGACCAAGAATTAGATATTAATCGTTTAAGTGATTATGATGTCGA

TCACATTGTTCCACAAAGTTTCCTTAAAGACGATTCAATAGACAATAAGGTCTTAACGCGTTCTGATAAAAATC

GTGGTAAATCGGATAACGTTCCAAGTGAAGAAGTAGTCAAAAAGATGAAAAACTATTGGAGACAACTTCTAAAC

GCCAAGTTAATCACTCAACGTAAGTTTGATAATTTAACGAAAGCTGAACGTGGAGGTTTGAGTGAACTTGATAA

AGCTGGTTTTATCAAACGCCAATTGGTTGAAACTCGCCAAATCACTAAGCATGTGGCACAAATTTTGGATAGTC

GCATGAATACTAAATACGATGAAAATGATAAACTTATTCGAGAGGTTAAAGTGATTACCTTAAAATCTAAATTA

GTTTCTGACTTCCGAAAAGATTTCCAATTCTATAAAGTACGTGAGATTAACAATTACCATCATGCCCATGATGC

GTATCTAAATGCCGTCGTTGGAACTGCTTTGATTAAGAAATATCCAAAACTTGAATCGGAGTTTGTCTATGGTG

ATTATAAAGTTTATGATGTTCGTAAAATGATTGCTAAGTCTGAGCAAGAAATAGGCAAAGCAACCGCAAATAT

TTCTTTTACTCTAATATCATGAACTTCTTCAAAACAGAAATTACACTTGCAAATGGAGAGATTCGCAAACGCCC

TCTAATCGAAACTAATGGGGAAACTGGAGAAATTGTCTGGGATAAAGGGCGAGATTTTGCCACAGTGCGCAAAG

TATTGTCCATGCCCCAAGTCAATATTGTCAAGAAAACAGAAGTACAGACAGGCGGATTCTCCAAGGAGTCAATT

TTACCAAAAAGAAATTCGGACAAGCTTATTGCTCGTAAAAAGACTGGGATCCAAAAAAATATGGTGGTTTTGA

TAGTCCAACGGTAGCTTATTCAGTCCTAGTGGTTGCTAAGGTGGAAAAAGGGAAATCGAAGAAGTTAAAATCCG

TTAAAGAGTTACTAGGGATCACAATTATGGAAAGAAGTTCCTTTGAAAAAAATCCGATTGACTTTTTAGAAGCT

AAAGGATATAAGGAAGTTAAAAAAGACTTAATCATTAAACTACCTAAATATAGTCTTTTTGAGTTAGAAAACGG

TCGTAAACGGATGCTGGCTAGTGCCGGAGAATTACAAAAAGGAAATGAGCTGGCTCTGCCAAGCAAATATGTGA

ATTTTTTATATTTAGCTAGTCATTATGAAAAGTTGAAGGGTAGTCCAGAAGATAACGAACAAAAACAATTGTTT

GTGGAGCAGCATAAGCATTATTTAGATGAGATTATTGAGCAAATCAGTGAATTTTCTAAGCGTGTTATTTTAGC

AGATGCCAATTTAGATAAAGTTCTTAGTGCATATAACAAACATAGAGACAAACCAATACGTGAACAAGCAGAAA

ATATTATTCATTTATTTACGTTGACGAATCTTGGAGCTCCCGCTGCTTTTAAATATTTTGATACAACAATTGAT

CGTAAACGATATACGTCTACAAAAGAAGTTTTAGATGCCACTCTTATCCATCAATCCATCACTGGTCTTTATGA

AACACGCATTGATTTGAGTCAGCTAGGAGGTGACTGA
```

(SEQ ID NO: 10)
MDKK<u>YSIGLDIGTNSVGWAVITDEYKVPSKKFKVLGNTDRHSIKKNLIGALLFDSGETA</u>EATRLKRTARRRYTR

RKNRICYLQEIFSNEMAKVDDSFFHRLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSKNGYAGYIDDGASQE

EFYKFIKPILEKMDGTEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNFDKNLPNEKVLPKHSLLYEYF

TVYNELTKVKYVTEGMRKPAFLSGEQKKAIVDLLFKTNRKVTVKQLKEDYFKKIECFDSVEISGVEDRFNASLG

TYHDLLKIIKDKDFLDNEENEDILEDIVLTLTLFEDREMIEERLKTYAHLFDDKVMKQLKRRRYTGWGRLSRKL

INGIRDKQSGKTILDFLKSDGFANRNFMQLIHDDSLTFKEDIQKAQVSGQG<u>DSLHEHIANLAGSPAIKKGILQT

VKVVDELVKVMGRHKPENIVIEMAR</u>ENQTTQKGQKNSRERMKRIEEGIKELGSQILKEHPVENTQLQNEKLYLY

YLQNGRDMYVDQELDINRLSDYDVDHIVPQSFLKDDSIDNKVLTRSDKNRGKSDNVPSEEVVKKMKNYWRQLLN

AKLITQRKEDNLTKAERG<u>GLSELDKAGFIKRQLVETRQITKHVAQILDSRMNTKYDENDKLIREVKVITLKSKL

VSDFRKDFQFYKVREINNYHHAHDAYLNAVVGTALIKKYPKLESEFVYGDYKVYDVRKMIAKSEQEIGKATAKY

FFYSNIMNFEKTEITLANGEIRKRPLIEINGETGEIVWDKGRDFATVRKVLSMPQVNIVKKTEVQTGGFSKESI</u>

LPKRNSDKLIARKKDWDPKKYGGFDSPTVAYSVLVVAKVEKGKSKKLKSVKELLGITIMERSSFEKNPIDFLEA

```
KGYKEVKKDLIIKLPKYSLFELENGRKRMLASAGELQKGNELALPSKYVNFLYLASHYEKLKGSPEDNEQKQLF

VEQHKHYLDEIIEQISEFSKRVILADANLDKVLSAYNKHRDKPIREQAENIIHLFTLTNLGAPAAFKYFDTTID

RKRYTSTKEVLDATLIHQSITGLYETRIDLSQLGGD
(single underline: HNH domain; double underline: RuvC domain)
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1), *Geobacillus stearothermophilus* (NCBI Ref: NZ_CP008934.1); *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any of the organisms listed in Example 1.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and/or H840A mutation. In some embodiments, a dCas9 domain comprises the amino acid sequence of SEQ ID NO: 6.

In some embodiments, the Cas9 domain comprises a D10A mutation, while the residue at position 840 remains a histidine in the amino acid sequence provided in SEQ ID NO: 10, or at corresponding positions in any of the amino acid sequences provided in SEQ ID NOs: 11-260. Without wishing to be bound by any particular theory, the presence of the catalytic residue H840 restores the activity of the Cas9 to cleave the non-edited (e.g., non-deaminated) strand containing a G opposite the targeted C. Restoration of H840 (e.g., from A840) does not result in the cleavage of the target strand containing the C. Such Cas9 variants are able to generate a single-strand DNA break (nick) at a specific location based on the gRNA-defined target sequence, leading to repair of the non-edited strand, ultimately resulting in a G to A change on the non-edited strand. Briefly, the C of a C-G base pair can be deaminated to a U by a deaminase, e.g., an APOBEC deaminase. Nicking the non-edited strand, the strand having the G, facilitates removal of the G via mismatch repair mechanisms. Uracil-DNA glycosylase inhibitor protein (UGI) inhibits Uracil-DNA glycosylase (UDG), which prevents removal of the U.

In other embodiments, dCas9 variants having mutations other than D10A and H840A are provided, which, e.g., result

```
dCas9 (D10A and H840A):
                                                           (SEQ ID NO: 6)
MDKKYSIGLAIGTNSVGWAVITDEYKVPSKKFKVLGNTDRHSIKKNLIGALLFDSGETAEATRLKRTARRRYTRRKNR

ICYLQEIFSNEMAKVDDSFFHRLEESFLVEEDKKHERHPIFGNIVDEVAYHEKYPTIYHLRKKLVDSTDKADLRLIYL

ALAHMIKFRGHFLIEGDLNPDNSDVDKLFIQLVQTYNQLFEENPINASGVDAKAILSARLSKSRRLENLIAQLPGEKK

NGLFGNLIALSLGLTPNFKSNFDLAEDAKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKIEKILTFRIPYYVGPLARGNSRFAWMTRK

SEETITPWNFEEVVDKGASAQSFIERMTNFDKNLPNEKVLPKHSLLYEYFTVYNELTKVKYVTEGMRKPAFLSGEQKK

AIVDLLFKTNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMGRHKPENIVIEMARENQTTQKGQKNSRER

MKRIEEGIKELGSQILKEHPVENTQLQNEKLYLYYLQNGRDMYVDQELDINRLSDYDVDAIVPQSFLKDDSIDNKVLT

RSDKNRGKSNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVYGDYK

VYDVRKMIAKSEQEIGKATAKYFFYSNIMNFFKTEITLANGEIRKRPLIETNGETGEIVWDKGRDFATVRKVLSMPQV

NIVKKTEVQTGGFSKESKILPKRNSDKLIARKKDWDPKKYGGFDSPTVAYSVLVVAKVEKGKSKKLKSVKELLGITIME

RSSFEKNPIDFLEAKGYKEVKKDLIIKLPKYSLFELENGRKRMLASAGELQKGNELALPSKYVNFLYLASHYEKLKGS

PEDNEQKOLFVEQHKHYLDEIIEQISEFSKRVILADANLDKVLSAYNKHRDKPIREQAENIIHLFTLTNLGAPAAFKY

FDTTIDRKRYTSTKEVLDATLIHQSITGLYETRIDLSQLGGD
``` in nuclease inactivated Cas9 (dCas9). Such mutations, by way of example, include other amino acid substitutions at D10 and H820, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 10) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 10. In some embodiments, variants of dCas9 (e.g., variants of SEQ ID NO: 10) are provided having amino acid sequences which are shorter, or longer than SEQ ID NO: 10, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

The term "Cas9 nickase" or "Cas9n," as used herein, refers to a Cas9 protein that is capable of cleaving only one strand of a duplexed nucleic acid molecule (e.g., a duplexed DNA molecule). In some embodiments, a Cas9 nickase comprises a D10A mutation and has a histidine at position H840 of SEQ ID NO: 10, or a corresponding mutation in any of SEQ ID NOs: 11-260. For example, a Cas9 nickase may comprise the amino acid sequence as set forth in SEQ ID NO: 7. Such a Cas9 nickase has an active HNH nuclease domain and is able to cleave the non-targeted strand of DNA, i.e., the strand bound by the gRNA. Further, such a Cas9 nickase has an inactive RuvC nuclease domain and is not able to cleave the targeted strand of the DNA, i.e., the strand where base editing is desired. In some embodiments, a Cas9 nickase comprises a H840A mutation and has an aspartic acid at position D10 of SEQ ID NO: 10, or a corresponding mutation in any of SEQ ID NOs: 11-260. For example, a Cas9 nickase may comprise the amino acid sequence as set forth in SEQ ID NO: 8.

```
Exemplary Cas9 nickase (D10A; Cloning vector pPlatTET-gRNA2; Accession No.
BAV54124):
                                    (SEQ ID NO: 7; D10A mutation shown in bold)
MDKKYSIGLAIGTNSVGWAVITDEYKVPSKKFKVLGNTDRHSIKKNLIGALLFDSGETAEATRLKRTARRRYTR

RKNRICYLQEIFSNEMAKVDDSFFHRLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFEENPINASGVDAKAILSARLSKSRRL

ENLIAQLPGEKKNGLEGNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNEDKNLPNEKVLPKHSLLYEYF

TVYNELTKVKYVTEGMRKPAFLSGEQKKAIVDLLFKTNRKVTVKQLKEDYFKKIECFDSVEISGVEDRFNASLG

TYHDLLKIIKDKDFLDNEENEDILEDIVLTLTLFEDREMIEERLKTYAHLFDDKVMKQLKRRRYTGWGRLSRKL

INGIRDKQSGKTILDFLKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILKEHPVENTQLQNEKLYLY

YLQNGRDMYVDQELDINRLSDYDVDHIVPQSFLKDDSIDNKVLTRSDKNRGKSDNVPSEEVVKKMKNYWRQLLN

AKLITQRKFDNLTKAERGGLSELDKAGFIKRQLVETRQITKHVAQILDSRMNTKYDENDKLIREVKVITLKSKL

VSDFRKDFQFYKVREINNYHHAHDAYLNAVVGTALIKKYPKLESEFVYGDYKVYDVRKMIAKSEQEIGKATAKY

FFYSNIMNFFKTEITLANGEIRKRPLIETNGETGEIVWDKGRDFATVRKVLSMPQVNIVKKTEVQTGGFSKESI

LPKRNSDKLIARKKDWDPKKYGGFDSPTVAYSVLVVAKVEKGKSKKLKSVKELLGITIMERSSFEKNPIDFLEA

KGYKEVKKDLIIKLPKYSLFELENGRKRMLASAGELQKGNELALPSKYVNFLYLASHYEKLKGSPEDNEQKQLF

VEQHKHYLDEIIEQISEFSKRVILADANLDKVLSAYNKHRDKPIREQAENIIHLFTLTNLGAPAAFKYFDTTID

RKRYTSTKEVLDATLIHQSITGLYETRIDLSQLGGD

Exemplary Cas9 nickase (H804A):
                                    (SEQ ID NO: 8; H840A mutation shown in bold)
MDKKYSIGLDIGTNSVGWAVITDEYKVPSKKFKVLGNTDRHSIKKNLIGALLFDSGETAEATRLKRTARRRYTR

RKNRICYLQEIFSNEMAKVDDSFFHRLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFEENPINASGVDAKAILSARLSKSRRL

ENLIAQLPGEKKNGLEGNLIALSLGLTPNFKSNFDLAEDAKLQLSKDTYDDDLDNLLAQIGDQYADLFLAAKNL

SDAILLSDILRVNTEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPFLKDNREKIEKIL

TERIPYYVGPLARGNSRFAWMTRKSEETITPWNFEEVVDKGASAQSFIERMTNFDKNLPNEKVLPKHSLLYEYF
```

-continued

```
TVYNELTKVKYVTEGMRKPAFLSGEQKKAIVDLLFKTNRKVTVKQLKEDYFKKIECFDSVEISGVEDRFNASLG

TYHDLLKIIKDKDFLDNEENEDILEDIVLTLTLFEDREMIEERLKTYAHLFDDKVMKQLKRRRYTGWGRLSRKL

INGIRDKQSGKTILDFLKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILKEHPVENTQLQNEKLYLY

YLQNGRDMYVDQELDINRLSDYDVDAIVPQSFLKDDSIDNKVLTRSDKNRGKSDNVPSEEVVKKMKNYWRQLLN

AKLITQRKFDNLIKAERGGLSELDKAGFIKRQLVETRQITKHVAQILDSRMNTKYDENDKLIREVKVITLKSKL

VSDFRKDFQFYKVREINNYHHAHDAYLNAVVGTALIKKYPKLESEFVYGDYKVYDVRKMIAKSEQEIGKATAKY

FFYSNIMNFFKTEITLANGEIRKRPLIETNGETGEIVWDKGRDFATVRKVLSMPQVNIVKKTEVQTGGFSKESI

LPKRNSDKLIARKKDWDPKKYGGFDSPTVAYSVLVVAKVEKGKSKKLKSVKELLGITIMERSSFEKNPIDFLEA

KGYKEVKKDLIIKLPKYSLFELENGRKRMLASAGELQKGNELALPSKYVNFLYLASHYEKLKGSPEDNEQKQLF

VEQHKHYLDEIIEQISEFSKRVILADANLDKVLSAYNKHRDKPIREQAENIIHLFTLTNLGAPAAFKYFDTTID

RKRYTSTKEVLDATLIHQSITGLYETRIDLSQLGGD
```

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all. Exemplary amino acid sequences of suitable Cas9 domains and Cas9 fragments are provided herein, and additional suitable sequences of Cas9 domains and fragments will be apparent to those of ordinary skill in the art. In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* I (NCBI Ref: NC_018721.1); *Streptococcus thermophilus* (NCBI Ref: YP_820832.1); *Geobacillus stearothermophilus* (NCBI Ref: NZ_CP008934.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

The term "deaminase" or "deaminase domain," as used herein, refers to a protein or enzyme that catalyzes a deamination reaction. In some embodiments, the deaminase or deaminase domain is a naturally-occurring deaminase from an organism, such as a human, chimpanzee, gorilla, monkey, cow, dog, rat, or mouse. In some embodiments, the deaminase or deaminase domain is a variant of a naturally-occurring deaminase from an organism, that does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase from an organism.

In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytidine deaminase domain, catalyzing the hydrolytic deamination of cytosine to uracil. In some embodiments, the cytidine deaminase catalyzes the hydrolytic deamination of cytidine or cytosine in deoxyribonucleic acid (DNA). In some embodiments, the cytidine deaminase domain comprises the amino acid sequence of any one of SEQ ID NO: 350-389. In some embodiments, the cytidine deaminase or cytidine deaminase domain is a naturally-occurring cytidine deaminase from an organism, such as a human, chimpanzee, gorilla, monkey, cow, dog, rat, or mouse. In some embodiments, the cytidine deaminase or cytidine deaminase domain is a variant of a naturally-occurring cytidine deaminase from an organism that does not occur in nature. For example, in some embodiments, the cytidine deaminase or cytidine deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring cytidine deaminase from an organism, such as a human, chimpanzee, gorilla, monkey, cow, dog, rat, or mouse.

In some embodiments, the deaminase or deaminase domain is an adenosine deaminase, which catalyzes the hydrolytic deamination of adenine or adenosine. In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenine or adenosine in deoxyribonucleic acid (DNA). The adenosine deaminases (e.g., engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as *E. coli, S. aureus, S. typhi, S. putrefaciens, H. influenzae*, or *C. crescentus*. In some embodiments, the adenosine deaminase is a TadA deaminase. In some embodiments, the TadA deaminase is an *E. coli* TadA deaminase (ecTadA). In some embodiments, the TadA deaminase is a truncated *E. coli* TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. In some embodiments, the adenosine deaminase comprises the amino acid sequence of any one of SEQ ID NOs: 400-408. In some embodiments, the adenosine deaminase comprises the amino acid sequence of any one of SEQ ID NOs: 409-458.

In some embodiments, the TadA deaminase is an N-terminal truncated TadA. In certain embodiments, the adenosine deaminase comprises the amino acid sequence:

(SEQ ID NO: 400)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD.

In some embodiments the TadA deaminase is a full-length *E. coli* TadA deaminase. For example, in certain embodiments, the adenosine deaminase comprises the amino acid sequence:

(SEQ ID NO: 401)
MRRAFITGVFFLSEVEFSHEYWMRHALTLAKRAWDEREVPVGAVLVHNNR

VIGEGWNRPIGRHDPTAHAEIMALRQGGLVMQNYRLIDATLYVTLEPCVM

CAGAMIHSRIGRVVFGARDAKTGAAGSLMDVLHHPGMNHRVEITEGILAD

ECAALLSDFFRMRRQEIKAQKKAQSSTD

It should be appreciated, however, that additional adenosine deaminases useful in the present application would be apparent to the skilled artisan and are within the scope of this disclosure. For example, the adenosine deaminase may be a homolog of an ADAT. Exemplary ADAT homologs include, without limitation:

*Staphylococcus aureus* TadA:
(SEQ ID NO: 402)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCSGSLMNLLQQSNFNHRAIVDKGVLKEACSTLLTTFFK

NLRANKKSTN

*Bacillus subtilis* TadA:
(SEQ ID NO: 403)
MTQDELYMKEAIKEAKKAEEKGEVPIGAVLVINGEIIARAHNLRETEQRS

IAHAEMLVIDEACKALGTWRLEGATLYVTLEPCPMCAGAVVLSRVEKVVF

GAFDPKGGCSGTLMNLLQEERFNHQAEVVSGVLEEECGGMLSAFFRELRK

KKKAARKNLSE

*Salmonella typhimurium* TadA:
(SEQ ID NO: 404)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAGPAV

*Shewanella putrefaciens* TadA:
(SEQ ID NO: 405)
MDEYWMQVAMQMAEKAEAAGEVPVGAVLVKDGQQIATGYNLSISQHDPTA

HAEILCLRSAGKKLENYRLLDATLYITLEPCAMCAGAMVHSRIARVVYGA

RDEKTGAAGTVVNLLQHPAFNHQVEVTSGVLAEACSAQLSRFFKRRRDEK

KALKLAQRAQQGIE

*Haemophilus influenzae* F3031 (*H. influenzae*) TadA:
(SEQ ID NO: 406)
MDAAKVRSEFDEKMMRYALELADKAEALGEIPVGAVLVDDARNIIGEGWN

LSIVQSDPTAHAEIIALRNGAKNIQNYRLLNSTLYVTLEPCTMCAGAILH

SRIKRLVFGASDYKTGAIGSRFHFFDDYKMNHTLEITSGVLAEECSQKLS

TFFQKRREEKKIEKALLKSLSDK

*Caulobacter crescentus* TadA:
(SEQ ID NO: 407)
MRTDESEDQDHRMMRLALDAARAAAEAGETPVGAVILDPSTGEVIATAGN

GPIAAHDPTAHAEIAAMRAAAAKLGNYRLTDLTLVVTLEPCAMCAGAISH

ARIGRVVFGADDPKGGAVVHGPKFFAQPTCHWRPEVTGGVLADESADLLR

GFFRARRKAKI

*Geobacter sulfurreducens* TadA:
(SEQ ID NO: 408)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP

It should be appreciated that, in some embodiments, effector domains may be used in place of any of the deaminases or deaminase domains provided herein. As used herein, an "effector domain" refers to a molecule (e.g., a protein) that regulates a biological activity and/or is capable of modifying a biological molecule (e.g., a protein, or a nucleic acid such as DNA or RNA). In some embodiments, the effector domain is a protein. In some embodiments, the effector domain is capable of modifying a protein (e.g., a histone). In some embodiments, the effector domain is capable of modifying DNA (e.g., genomic DNA). In some embodiments, the effector domain is capable of modifying RNA (e.g., mRNA). In some embodiments, the effector molecule is a nucleic acid editing domain. In some embodiments, the effector molecule is capable of regulating an activity of a nucleic acid (e.g., transcription, and/or translation). Exemplary effector domains include, without limitation, a deaminase, a nuclease, a nickase, a recombinase, a methyltransferase, a methylase, an acetylase, an acetyltransferase, a transcriptional activator, or a transcriptional repressor domain.

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. In some embodiments, an effective amount of a fusion protein provided herein, e.g., of a fusion protein comprising a nuclease-inactive Cas9 domain and a nucleic acid editing domain (e.g., a deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nuclease, a deaminase, a recombinase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The term "expression" encompasses the processes by which nucleic acids (e.g., DNA) are transcribed to produce RNA, and (where applicable) RNA transcripts are processed and translated into polypeptides.

The term "gene" as used herein refers to a nucleic acid sequence (e.g., DNA or RNA) that encodes a molecule (e.g., a protein). In general, a gene is a double-stranded DNA molecule that encodes a protein. A gene generally comprises coding DNA sequences (e.g., exons), non-coding DNA sequences (e.g., introns), and one or more promoters or other regulatory element that controls gene expression. An organism's entire set of genes is referred as its genome.

In some embodiments, the gene is a reporter gene. In general, a reporter gene is often used to study the activity (e.g., expression) of a regulatory sequence of interest (e.g., a promoter). In some embodiments, the reporter gene is operably linked to a regulatory sequence (e.g., a promoter). Exemplary, non-limiting examples of a reporter gene include the lacz gene, which encodes beta-galactosidase, the cat gene, which encodes chloramphenicol acetyltransferase (Cat), the gfp gene, which encodes green fluorescent protein (GFP, or EGFP), and the rfp gene, which encodes red fluorescent protein (RFP). In some embodiments, the reporter gene encodes a reporter protein. In general, a reporter protein is a protein whose expression is operably linked to a promoter or gene of interest. The expression of a reporter protein generally indicates that the promoter or gene of interest is being expressed in a cell. In some embodiments, the reporter protein is a fluorescent protein. In some embodiments, the fluorescent protein is a green fluorescent protein (GFP). In some embodiments, the fluorescent protein is an enhanced green fluorescent protein (EGFP). In some embodiments, the fluorescent protein is a red fluorescent protein (RFP).

The term "locus" (plural "loci") as used herein refers to a fixed position on a chromosome, such as the position of a gene or marker (i.e., genetic marker). A variant of a similar DNA sequence located at a given locus is called an allele. In some embodiments, the locus is a safe harbor locus. The term "safe harbor locus" refers to a position on the chromosome (i.e., locus) that can tolerate the insertion, deletion, and/or mutation of the nucleic acid sequence in the safe harbor locus without perturbing the endogenous activity of the gene or risking the integrity of the host genome. In some embodiments, a gene is located in a safe harbor locus (i.e., a safe harbor gene). In some embodiments, the gene is the chemokine (C-C motif) receptor 5 (CCR5) gene. In some embodiments, the gene is the adeno-associated virus site 1 (AAVS1) gene. In some embodiments, the safe harbor locus is the Rosa26 locus (e.g., from mice, or the human ortholog). Safe harbor genes are described in, e.g., Papapetrou E P and Schambach A (2016) Gene insertion into genomic safe harbors for human gene therapy. *Mol Ther* 24(4), 678-684, which is incorporated by reference herein. In some embodiments, a safe harbor locus is used as a recording locus as described herein.

The term "linker," as used herein, refers to a chemical group or a molecule linking two molecules or moieties, e.g., two domains of a fusion protein, such as, for example, a nuclease-inactive Cas9 domain and a nucleic acid editing domain (e.g., a deaminase domain). A linker may be, for example, an amino acid sequence, a peptide, or a polymer of any length and composition. In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. In some embodiments, a linker joins a Cas9n and a nucleic-acid editing protein. In some embodiments, a linker joins an RNA-programmable nuclease domain and a UGI domain. In some embodiments, a linker joins a dCas9 and a UGI domain. In some embodiments, a linker joins a Cas9n and a UGI domain. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker comprises the amino acid sequence of any one of SEQ ID NOs: 300-318. In some embodiments, the linker is 1-100 amino acids in length, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. In some embodiments, a linker comprises the amino acid sequence SGSETPGTSESATPES (SEQ ID NO: 306), which may also be referred to as the XTEN linker. In some embodiments, a linker comprises the amino acid sequence SGGS (SEQ ID NO: 309). In some embodiments, a linker comprises the amino acid sequence (SGGS)$_2$-SGSETPGTSESATPES-(SGGS)$_2$ (SEQ ID NO: 308), which may also be referred to as (SGGS)$_2$-XTEN-(SGGS)$_2$. In some embodiments, a linker comprises (SGGS)$_n$ (SEQ ID NO: 305), (GGGS)$_n$ (SEQ ID NO: 300), (GGGGS)$_n$ (SEQ ID NO: 301), (G)$_n$ (SEQ ID NO: 302), (EAAAK)$_n$ (SEQ ID NO: 303), (GGS)$_n$ (SEQ ID NO: 304), SGGS(GGS)$_n$ (SEQ ID NO: 307), (SGGS)$_n$-SGSETPGTS-ESATPES-(SGGS)$_n$ (SEQ ID NO: 310), or (XP)$_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, n is 1, 3, or 7. In some embodiments, the linker comprises the amino acid sequence

GGSGGSPGSPAGSPTSTEEGTSESATPESGPGTSTEPSEGSAPGSPAGSP (SEQ ID NO: 314)

TSTEEGTSTEPSEGSAPGTSTEPSEGSAPGTSESATPESGPGSEPATSGG

SGGS,

SGGSSGGSSGSETPGTSESATPES, (SEQ ID NO: 315)

SGGSSGGSSGSETPGTSESATPESSGGSSGGSSGGSSGGS, (SEQ ID NO: 316)

SGGSSGGSSGSETPGTSESATPESSGGSSGGSSGGSSGGSSGSETPGTSE (SEQ ID NO: 317)

SATPESSGGSSGGS,
or

PGSPAGSPTSTEEGTSESATPESGPGTSTEPSEGSAPGSPAGSPTSTEEG (SEQ ID NO: 318)

TSTEPSEGSAPGTSTEPSEGSAPGTSESATPESGPGSEPATS.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the nucleic acid and amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides.

Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "nucleic acid editing domain," as used herein refers to a protein or enzyme capable of making one or more modifications (e.g., deamination of a cytidine residue) to a nucleic acid (e.g., DNA or RNA). Exemplary nucleic acid editing domains include, but are not limited to a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain is a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain is a deaminase domain (e.g., a cytidine deaminase, such as an APOBEC or an AID deaminase, or an adenosine deaminase, such as ecTadA). In some embodiments, the nucleic acid editing domain is a cytidine deaminase domain (e.g., an APOBEC or an AID deaminase). In some embodiments, the nucleic acid editing domain is an adenosine deaminase domain (e.g., an ecTadA).

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., international PCT application, PCT/EP2000/011690, filed Nov. 23, 2000, published as WO/2001/038547 on May 31, 2001, the contents of which are incorporated herein by reference for their disclosure of exemplary nuclear localization sequences. In some embodiments, a NLS comprises the amino acid sequence PKKKRKV (SEQ ID NO: 520) or MDSLLMNRRKFLY-QFKNVRWAKGRRETYLC (SEQ ID NO: 521).

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid programmable DNA binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), the entire contents of which are incorporated herein by reference.

The term "promoter" as used herein refers to a control region of a nucleic acid sequence (e.g., within a plasmid) at which initiation and rate of transcription of the remainder of a nucleic acid sequence are controlled. A promoter may also contain sub-regions to which regulatory proteins and molecules may bind, such as RNA polymerase and other transcription factors. In some embodiments, a promoter controls the expression of a nucleic acid sequence (e.g., a gene) that is operably linked to the promoter. A promoter is located on the same strand and upstream of the nucleic acid sequence (e.g., gene) that is operably linked to the promoter. In general, promoters are between 100-1000 base pairs long. In some embodiments, the promoter is a promoter suitable for use in a prokaryotic system (i.e., a bacterial promoter). In some embodiments, the promoter is a promoter suitable for use in a eukaryotic system (i.e., a eukaryotic promoter). In some embodiments, the promoter is a promoter suitable for use in a mammalian (e.g., human) system (i.e., a mammalian promoter). In some embodiments, the promoter is induced by a stimulus (i.e., an inducible promoter). In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the stimulus is light. In some embodiments, the stimulus is a virus. In some embodiments, the stimulus is a small molecule. In some embodiments, the stimulus is an antibiotic. In some embodiments, the stimulus is anhydrotetracycline, tanespimycin, tunicamycin, or doxycycline. In some embodiments, the stimulus is a sugar. In some embodiments, the stimulus is arabinose, rhamnose, or IPTG. In some embodiments, the stimulus is a signaling molecule produced during an activated signaling cascade (e.g., beta-catenin produced during an activated Wnt signaling cascade, cytokines such as TNFα, TGF-β1, IFN-α, IFN-γ, or IL-6 produced during immunological and inflammatory responses, or growth factors such as EGF). In some embodiments, the stimulus is a cancer drug. In some embodiments, the stimulus is a vitamin. In some embodiments, the stimulus is a steroid. Additional promoters that detect signaling molecules can be generated to induce the expression of the nucleic acid sequence operably linked to the promoter, for example, promoters that record an endogenous pathway, including immune response (IL-2 promoter), a cAMP responsive element (CREB), NFκB signaling, interferon response, P53 (DNA damage), Sox2, TGF-ß signaling (SMAD), Erk (e.g., from an activated Ras/Raf/Mek/Erk cascade), PI3K/AKT (e.g., from an activated Ras/PI3K/Akt cascade), heat shock, Notch signaling, Oct4, an aryl hydrocarbon receptor, or an AP-1 transcription factor. In some embodiments, the promoter is a constitutive promoter. In some embodiments, the promoter is a promoter listed in Table 3. Non-limiting, exemplary constitutive and inducible bacterial promoters are shown in Table 7. Non-limiting, exemplary constitutive and inducible eukaryotic promoters are shown in Table 8 and Table 10. Additional suitable promoters for use in both prokaryotic and eukaryotic systems will be apparent to those of ordinary skill in the art based on this disclosure and knowledge in the field, and are within the scope of the present disclosure.

The term "repressor" as used herein refers to a DNA- or RNA-binding protein that binds to a repressor binding site (e.g., an operator, a promoter, or a silencing sequence) to inhibit the expression of one or more genes. A DNA-binding repressor blocks the attachment of RNA polymerase to the promoter, thus preventing transcription of the downstream nucleic acid sequence (e.g., gene) operably linked to the promoter into messenger RNA and consequent expression of the protein encoded by the gene. An inducer, i.e., a molecule that initiates the gene expression, can interact with the repressor protein and detach it from the operator (e.g., the promoter). In some embodiments, the repressor is a LacI repressor that represses the expression of a nucleic acid sequence operably linked to a lactose-inducible (e.g., an IPTG-inducible) promoter. In some embodiments, the repressor is a tetracycline repressor (TetR) that represses the expression of a nucleic acid sequence operably linked to a tetracycline-inducible promoter. Additional suitable repressor systems will be apparent to those of ordinary skill in the art based on this disclosure and knowledge in the field, and are within the scope of the present disclosure.

The term "plasmid" as used herein refers to a circular, double-stranded DNA molecule comprising an origin of replication. When present in a cell, a plasmid is separate and distinct from the host chromosomal DNA, where the host may be, for example, a bacterial cell (e.g., *Escherichia coli*) or a eukaryotic cell (e.g., mammalian (e.g., human) cell). In general, a plasmid may be introduced into a cell via a transfection reaction (e.g., transformation, electroporation, heat shock), or other suitable technique known in the field of molecular biology. In some embodiments, a plasmid is transfected into a cell using a cationic lipid. In some embodiments, the cationic lipid is Lipofectamine® 2000. Additional suitable cationic lipid reagents are described in Patent Publication No. WO2016/070129, published May 6, 2016, which is hereby incorporated by reference. Plasmids are often used in molecular cloning as a tool to drive the replication and expression of recombinant DNA sequences within host organisms. In some embodiments, the plasmid is expressed in a cell. In some embodiments, any of the plasmids described herein can comprise a nucleic acid sequence encoding an additional protein (e.g., a reporter protein or a repressor protein). In some embodiments, the nucleic acid sequence encoding the additional protein is separated from a nucleic acid sequence encoding another component (e.g., sgRNA, napDNAbp, fusion protein) in the plasmid by an intervening P2A sequence. Without wishing to be bound by any particular theory, a P2A sequence is used in engineered plasmids to permit a nucleic acid sequence encoding two distinct gene products operably linked to the same promoter to express the two gene products without having to reinitiate transcription (i.e., the ribosome does not release from the nucleic acid after it has transcribed the first gene product). In some embodiments, the plasmid comprises an additional nucleic acid sequence encoding an additional protein (e.g., a reporter protein or repressor protein) connected to the 3' end of any one of the nucleic acid sequences in the plasmid by an intervening P2A sequence.

In some embodiments, the plasmid is a writing plasmid. In some embodiments, the writing plasmid is a circular, double-stranded DNA molecule that comprises a nucleic acid (i.e., DNA) sequence encoding a nucleic acid programmable DNA binding protein (napDNAbp) and a nucleic acid (i.e., DNA) sequence encoding a sgRNA. In some embodiments, the napDNAbp is a Cas9 domain. In some embodiments, the Cas9 domain is a nuclease active Cas9 domain, a Cas9n domain, or a dCas9 domain. In some embodiments, the nucleic acid sequence encoding the nucleic acid programmable DNA binding protein (napDNAbp) is operably linked to a promoter. In some embodiments, the nucleic acid sequence encoding the sgRNA is operably linked to a promoter. In some embodiments, a writing plasmid comprises a Cas9 domain (e.g., dCas9, Cas9n, nuclease active Cas9) and a nucleic acid (i.e., DNA) sequence encoding a sgRNA. In some embodiments, the nucleic acid sequence encoding the Cas9 domain (e.g., dCas9, Cas9n, nuclease active Cas9) is operably linked to a promoter. In some embodiments, the nucleic acid sequence encoding the sgRNA is operably linked to a promoter. In some embodiments, a writing plasmid comprises more than one nucleic acid sequence encoding a napDNAbp, wherein each nucleic acid sequence is operably linked to a promoter. In some embodiments, a writing plasmid comprises more than one nucleic acid sequence encoding more than one sgRNAs, wherein each nucleic acid sequence is operably linked to a promoter. In some embodiments, the writing plasmid does not comprise a nucleic acid sequence encoding a sgRNA. In some embodiments, any of the nucleic acid sequences encoding an sgRNA in the writing plasmid can alternatively be included in a separate plasmid (e.g., an "accessory plasmid") for use with the appropriate writing plasmid. In some embodiments, the writing plasmid comprises an additional nucleic acid sequence encoding an additional protein (e.g., a reporter protein or repressor protein) connected to the 3' end of any one of the nucleic acid sequences in the writing plasmid by an intervening P2A sequence.

In some embodiments, the writing plasmid is a circular, double-stranded DNA molecule that comprises a nucleic acid (i.e., DNA) sequence encoding a fusion protein and a nucleic acid (i.e., DNA) sequence encoding a sgRNA. In some embodiments, the fusion protein comprises a nucleic acid programmable DNA binding protein (napDNAbp) and a nucleic acid editing domain. In some embodiments, the nucleic acid sequence encoding the fusion protein is operably linked to a promoter. In some embodiments, the nucleic acid sequence encoding the sgRNA is operably linked to a promoter. In some embodiments, the fusion protein comprises a Cas9 domain (e.g., dCas9, Cas9n, nuclease active Cas9) and nucleic acid editing domain. In some embodiments, a writing plasmid comprises more than one nucleic acid sequence encoding a fusion protein comprising a napDNAnp and a nucleic acid editing domain, wherein each nucleic acid sequence is operably linked to a promoter. In some embodiments, the writing plasmid comprises a fusion protein comprising a napDNAbp (e.g., a Cas9 domain) and a fusion protein comprising an orthogonal napDNAbp (e.g., an orthogonal Cas9 domain), wherein the two napDNAbps require different sgRNA binding parameters. In some embodiments, a writing plasmid comprises more than one nucleic acid sequence encoding more than one sgRNA, wherein each nucleic acid sequence is operably linked to a promoter. In some embodiments, the writing plasmid does not comprise a nucleic acid sequence encoding a sgRNA.

In some embodiments, the plasmid is a recording plasmid. The term "recording plasmid" as used herein refers to a circular, double-stranded DNA molecule that comprises a target sequence. In some embodiments, the target sequence is complementary to a sgRNA sequence provided herein, for example, a sgRNA sequence comprising a nucleic acid sequence shown in Table 5. In some embodiments, the target sequence is present in a reporter gene. In some embodiments, the reporter gene is EFGP. In some embodiments, the target sequence encodes a protein. In some embodiments, the protein is a reporter protein, for example, a fluorescent protein. In some embodiments, the reporter protein is a green fluorescent protein (GFP). In some embodiments, the protein is an antibiotic resistance protein, or variant thereof. In some embodiments, the antibiotic resistance protein is chloramphenicol acetyltransferase (Cat). In some embodiments, the antibiotic resistance protein is a Cat variant (e.g., the Cat variant comprises one or more inactivating mutations). In some embodiments, the Cat variant does not confer chloramphenicol resistance. In some embodiments, the antibiotic resistance protein is aminoglycoside-3'-phosphotransferase (Aph3'). In some embodiments, the antibiotic resistance protein is an Aph3' variant (e.g., the Aph3' protein comprises one or more inactivating mutations). In some embodiments, the Aph3' variant does not confer kanamycin resistance.

The term "origin of replication" as used herein refers to a sequence at which replication (e.g., DNA transcription) is initiated. The DNA sequence of the origin of replication (ORI) varies among species, but in general comprises a high content of both adenine (A) and thymine (T). The term origin of replication encompasses both prokaryotic (e.g., bacterial) and eukaryotic (e.g., mammalian) origins of replication. In general, a plasmid comprises at least one origin of replication. In some embodiments, a plasmid comprises one origin of replication.

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to, in some embodiments, a sequence within a nucleic acid molecule that is deaminated by a deaminase or a fusion protein comprising a deaminase, (e.g., a dCas9-deaminase fusion protein or a Cas9n-deaminase fusion protein provided herein). In some embodiments, the target site refers to a sequence within a nucleic acid molecule that is cleaved by a napDNAbp (e.g., a nuclease active Cas9 domain) provided herein. The target site is contained within a target sequence (e.g., a target sequence comprising a reporter gene, or a target sequence comprising a gene located in a safe harbor locus).

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

The term "pharmaceutical composition," as used herein, refers to a composition that can be administrated to a subject in the context of treatment of a disease or disorder. In some embodiments, a pharmaceutical composition comprises an active ingredient, e.g., a nuclease or a nucleic acid encoding a nuclease, and a pharmaceutically acceptable excipient.

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 500. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 500. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 500. In some embodiments, a UGI comprises an amino acid sequence homologous to the amino acid sequence set forth in SEQ ID NO: 500, or an amino acid sequence homologous to a fragment of the amino acid sequence set forth in SEQ ID NO: 500. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 500. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 500. In some embodiments, the UGI comprises the amino acid sequence of SEQ ID NO: 500, as set forth below.

Exemplary Uracil-DNA glycosylase inhibitor (UGI; >sp|P14739|UNGI_BPPB2) MTNLSDIIEKETG-KOLVIQESILMLPEEVEEVIGNKPESDILVHTAYDEST-DENVMLLTSDAPEYKPWALVIQDSNGE NKIKML (SEQ ID NO: 500)

The term "catalytically inactive inosine-specific nuclease," or "dead inosine-specific nuclease (dISN)," as used herein, refers to a protein that is capable of inhibiting an inosine-specific nuclease. Without wishing to be bound by any particular theory, catalytically inactive inosine glycosylases (e.g., alkyl adenine glycosylase [AAG]) will bind inosine, but will not create an abasic site or remove the inosine, thereby sterically blocking the newly-formed inosine moiety from DNA damage/repair mechanisms. In some embodiments, the catalytically inactive inosine-specific nuclease may be capable of binding an inosine in a nucleic acid but does not cleave the nucleic acid. Exemplary catalytically inactive inosine-specific nucleases include, without limitation, catalytically inactive alkyl adenosine glycosylase (AAG nuclease), for example, from a human, and catalytically inactive endonuclease V (EndoV nuclease), for example, from E. coli. In some embodiments, the catalytically inactive AAG nuclease comprises an E125Q mutation as shown in SEQ ID NO: 510, or a corresponding mutation in another AAG nuclease. In some embodiments, the catalytically inactive AAG nuclease comprises the amino acid sequence set forth in SEQ ID NO: 510. In some embodiments, the catalytically inactive EndoV nuclease comprises an D35A mutation as shown in SEQ ID NO: 511, or a corresponding mutation in another EndoV nuclease. In some embodiments, the catalytically inactive Endo V nuclease comprises the amino acid sequence set forth in SEQ ID NO: 511. It should be appreciated that other catalytically inactive inosine-specific nucleases (dISNs) would be apparent to the skilled artisan and are within the scope of this disclosure.

```
Truncated AAG (H. sapiens) nuclease (E125Q);
mutated residue shown in bold.
                                      (SEQ ID NO: 510)
KGHLTRLGLEFFDQPAVPLARAFLGQVLVRRLPNGTELRGRIVETQAYLG

PEDEAAHSRGGRQTPRNRGMFMKPGTLYVYIIYGMYFCMNISSQGDGACV

LLRALEPLEGLETMRQLRSTLRKGTASRVLKDRELCSGPSKLCQALAINK

SFDQRDLAQDEAVWLERGPLEPSEPAVVAAARVGVGHAGEWARKPLRFYV

RGSPWVSVVDRVAEQDTQA

EndoV nuclease (D35A); mutated residue shown in
bold.
                                      (SEQ ID NO: 511)
DLASLRAQQIELASSVIREDRLDKDPPDLIAGAAVGFEQGGEVTRAAMVL

LKYPSLELVEYKVARIATTMPYIPGFLSFREYPALLAAWEMLSQKPDLVF

VDGHGISHPRRLGVASHFGLLVDVPTIGVAKKRLCGKFEPLSSEPGALAP

LMDKGEQLAWVWRSKARCNPLFIATGHRVSVDSALAWVQRCMKGYRLPEP

TRWADAVASERPAFVRYTANQP
```

DETAILED DESCRIPTION OF CERTAIN EMBODIMENTS

Provided herein are compositions (e.g., nucleic acids), cells, systems, kits, and methods for recording the strength and/or duration of endogenous or exogenous stimuli over the course of a cell's lifetime. Some aspects of the disclosure provide a cell data recording system comprising a nucleic acid programmable DNA binding protein (napDNAbp) (e.g., a Cas9 domain) or a fusion protein comprising a nucleic acid programmable DNA binding protein and a nucleic acid editing domain (e.g., a base editor) operably linked to a promoter that induces the expression of the napDNA or the fusion protein to induce changes in cellular DNA (e.g., double-strand breaks, nucleobase editing) in response to a stimulus or change in cell. In contrast to digital memory devices that store information (e.g., the presence or absence of a stimulus) in one of two distinct states (i.e., "on" or "off"), these cell data recorders can induce permanent marks in cellular DNA in a manner that reflects both the strength (i.e., amplitude) and duration of one or more stimuli. Thus, in some aspects, provided herein are analog, multi-event cell data recording systems (also referred to as a "CRISPR-mediated analog multi-event recording apparatus" or "CAMERA") that have the ability to simultaneously record multiple cell states, including, for example, exposure to a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism. Importantly, these cell data recorders employ sequencing technologies (e.g., high-throughput sequencing) to measure readout (e.g., changes in cellular DNA) and are not dependent on large cell populations for both the recording of a stimulus or the readout of the change(s) in cellular DNA induced by the stimulus.

In certain embodiments, the cell data recorder systems provided herein for use in a cell comprise one or more writing plasmids or writing loci (e.g., as part of an integrated writing system), wherein each writing plasmid or writing locus encodes a nucleic acid programmable DNA binding protein (napDNAbp) or a fusion protein comprising a napDNAbp and a nucleic acid editing domain. The nucleic acid sequence of the writing plasmid/locus that encodes the napDNAbp or the fusion protein is operably linked to a promoter (e.g., an inducible promoter or a constitutive promoter). When a stimulus is present, or a change in cell state occurs, the stimulus induces the expression of the napDNAbp or the fusion protein encoded by the writing plasmid/locus. Also present within the cell is a guide RNA (gRNA or sgRNA) that associates with the napDNAbp and directs the napDNAbp or the fusion protein to a target sequence (i.e., the sgRNA is complementary to a target sequence). The sgRNA may be encoded by the writing plasmid/locus or by another plasmid/locus (e.g., an accessory plasmid) that is used in combination with the writing plasmid/locus, or the sgRNA may be expressed by the cell. When the sgRNA is encoded by a plasmid/locus (e.g., writing plasmid/locus, accessory plasmid), the nucleic acid sequence encoding the sgRNA may be operably linked to a promoter (e.g., an inducible promoter or a constitutive promoter). Under the correct stimulus, or correct set of stimuli, both the napDNAbp or the fusion protein and the sgRNA are expressed in the cell, and the sgRNA associates with the napDNAbp to direct the napDNAbp or the fusion protein to a target sequence. This target sequence records the activity of the napDNAbp (e.g., double-strand breaks) or the fusion protein (e.g., nucleobase editing), thereby recording the presence of a stimulus, or a set of stimuli, or a change in cell state. Additional sgRNA sequences can also be present in the cell (e.g., provided by the writing plasmid/locus, an accessory plasmid, a separate locus, or expressed in the cell), and these additional sgRNA sequences, which can direct the napDNAbp or the fusion protein to a distinct target sequence, can each be operably linked to a promoter that senses the presence of a different stimulus, allowing complex cell data recorder systems to be constructed for the ordered recording of the presence and duration of a stimulus, or set of stimuli. In some cases, one or more of the components of the cell data recorder system (e.g., napDNAbp, fusion protein, sgRNA) may be constitutively expressed in the cell. Exemplary writing plasmids, writing loci, recording plasmids, recording loci, additional plasmids (e.g., accessory plasmids) for use with the compositions described herein, and cell data recorder systems are provided. Additional suitable combinations of the writing plasmids, writing loci, recording plasmids, recording loci, additional plasmids (e.g., accessory plasmids) provided herein will be apparent to a person of ordinary skill in the art based on this disclosure and knowledge in the field, and thus are embraced by the scope of this disclosure.

Writing Plasmids

In one aspect, the present disclosure provides writing plasmids comprising a nucleic acid sequence encoding a nucleic acid programmable DNA binding protein (napDNAbp) operably linked to a promoter. This napDNAbp may be a nuclease active napDNAbp (e.g., a nuclease active Cas9 domain) or a nuclease inactive napDNAbp (e.g., a dCas9 domain or a Cas9n domain). Without wishing to be bound by any particular theory, the components of the writing plasmid (e.g., napDNAbp) are generally operably linked to a promoter sequence which controls the expression of each component (see, e.g., FIG. 1). In some embodiments, the components of the writing plasmid (e.g., napDNAbp) are operably linked to a single inducible promoter, such that the presence of the stimulus (e.g., a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism, etc.) induces expression of all the components of the writing plasmid simultaneously. In some embodiments, one or more of the components of the writing plasmid (e.g., napDNAbp) are operably linked to a constitutively active promoter, such that the component is constitutively expressed in cells. In some embodiments, each component of the writing plasmid (e.g., napDNAbp) is operably linked to a different inducible promoter, where expression of each component is only initiated in the presence of the correct set of stimuli (e.g., a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism, etc). The use of multiple different inducible promoters operably linked to separate components of the writing plasmid allows for the generation of cell data recorders that recapitulate an "AND" Boolean logic gate, where signal output (e.g., DNA double-strand breaks) is only recorded in the presence of all required stimuli, but not in the presence of only one stimulus (see, e.g., FIG. 2).

In one aspect, provided herein are writing plasmids comprising (i) a nucleic acid sequence encoding a nucleic acid programmable DNA binding protein (napDNAbp) operably linked to a promoter; and (ii) an origin of replication.

In some embodiments, the writing plasmid does not encode a sgRNA. In some embodiments, the napDNAbp encoded by the writing plasmid associates with a sgRNA expressed by a cell. In some embodiments, the napDNAbp associates with a sgRNA under conditions (e.g., a stimulus) that induce the expression of the napDNAbp, wherein the sgRNA is expressed by a cell. In some embodiments, the sgRNA is complementary to a target sequence.

In some embodiments, the promoter is appropriate for use in a prokaryotic system. In some embodiments, the promoter is appropriate for use in a bacterial (e.g., E. coli) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a pSC101, pMB1, pBR322, ColE1, or p15A origin of replication sequence. In some embodiments, the origin of replication comprises a pSC101 origin of replication sequence. In some embodiments, the origin of replication sequence comprises an origin of replication sequence shown in Table 3.

In some embodiments, the napDNAbp is a RNA-programmable DNA binding protein. In some embodiments, the napDNAbp is a nuclease active napDNAbp capable of introducing a double-strand break. In some embodiments, the RNA-programmable DNA binding protein is a Cas9 domain, a Cpf1 domain, a CasX domain, a CasY domain, a C2c1 domain, a C2c2 domain, or a C2c3 domain. In some embodiments, the RNA-programmable DNA binding protein is a Cas9 domain. In some embodiments, the Cas9 domain is a nuclease inactive Cas9 (dCas9) domain, a Cas9 nickase (Cas9n) domain, or a nuclease active Cas9 domain.

In some embodiments, the Cas9 domain is a nuclease active Cas9 domain. In some embodiments, the Cas9 domain is a Cas9 domain from Streptococcus pyogenes (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain comprises the amino acid sequence provided in any one of SEQ ID NOs: 10-260. In some embodiments, the Cas9 domain comprises the amino acid sequence of SEQ ID NO: 10. In some embodiments, the Cas9 domain consists of the amino acid sequence provided in any one of SEQ ID NOs: 10-260. In some embodiments, the Cas9 domain consists of the amino acid sequence of SEQ ID NO: 10.

In another aspect, provided herein are writing plasmids comprising (i) a nucleic acid sequence encoding (a) a nucleic acid programmable DNA binding protein (napDNAbp) and (b) a single guide RNA (sgRNA), wherein the nucleic acid sequence of (i) is operably linked to a promoter; and (ii) an origin of replication.

In some embodiments, the sgRNA associates with the napDNAbp under conditions (e.g., a stimulus or a set of stimuli) that induce the expression of the sgRNA and expression of the napDNAbp. In some embodiments, the sgRNA is complementary to a target sequence. In some embodiments, the writing plasmid does not encode a sgRNA. In some embodiments, the napDNAbp encoded by the writing plasmid associates with a sgRNA expressed by a cell. In some embodiments, the napDNAbp associates with a sgRNA under conditions (e.g., a stimulus) that induce the expression of the napDNAbp, wherein the sgRNA is expressed by a cell.

In some embodiments, the promoter is appropriate for use in a prokaryotic system. In some embodiments, the promoter is appropriate for use in a bacterial (e.g., E. coli) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a pSC101, pMB1, pBR322, ColE1, or p15A origin of replication sequence. In some embodiments, the origin of replication comprises a pSC101 origin of replication sequence. In some embodiments, the origin of replication sequence comprises an origin of replication sequence shown in Table 3.

In some embodiments, the napDNAbp is a RNA-programmable DNA binding protein. In some embodiments, the napDNAbp is a nuclease active napDNAbp capable of introducing a double-strand break. In some embodiments, the RNA-programmable DNA binding protein is a Cas9 domain, a Cpf1 domain, a CasX domain, a CasY domain, a C2c1 domain, a C2c2 domain, or a C2c3 domain. In some embodiments, the RNA-programmable DNA binding protein is a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease active Cas9 domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain comprises the amino acid sequence provided in any one of SEQ ID NOs: 10-260. In some embodiments, the Cas9 domain comprises the amino acid sequence of SEQ ID NO: 10. In some embodiments, the Cas9 domain consists of the amino acid sequence provided in any one of SEQ ID NOs: 10-260. In some embodiments, the Cas9 domain consists of the amino acid sequence of SEQ ID NO: 10.

In yet another aspect, provided herein are writing plasmids comprising (i) a nucleic acid sequence encoding a nucleic acid programmable DNA binding protein (napDNAbp) operably linked to a first promoter; (ii) a nucleic acid sequence encoding a single guide RNA (sgRNA) operably linked to a second promoter; and (iii) an origin of replication.

In some embodiments, the sgRNA associates with the napDNAbp under conditions (e.g., a stimulus or set of stimuli) that induce the expression of the sgRNA and expression of the napDNAbp. In some embodiments, the sgRNA is complementary to a target sequence. In some embodiments, the writing plasmid does not encode a sgRNA. In some embodiments, the napDNAbp encoded by the writing plasmid associates with a sgRNA expressed by a cell. In some embodiments, the napDNAbp associates with a sgRNA under conditions (e.g., a stimulus) that induce the expression of the napDNAbp, wherein the sgRNA is expressed by a cell.

In some embodiments, at least one of the promoters is induced by the presence of a stimulus. In some embodiments, the stimulus is a small molecule, a protein, a peptide, an amino acid, a metabolite, a sugar, a lipid, a metal, a molecule produced during the activation of an endogenous or exogenous signaling cascade, light, heat, mechanical stress, or a virus (e.g., phage). In some embodiments, the stimulus is anhydrotetracycline, IPTG, rhamnose, arabinose, or doxycycline. In some embodiments, at least one of the promoters is an inducible promoter. In some embodiments, at least one of the promoters is a constitutive promoter. In some embodiments, the first promoter and the second promoter are different promoters. In some embodiments, the first promoter and the second promoter are different inducible promoters.

In some embodiments, the first promoter is appropriate for use in a prokaryotic system. In some embodiments, the first promoter is appropriate for use in a bacterial (e.g., *E. coli*) system. In some embodiments, the first promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the first promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the first promoter is a constitutive promoter. In some embodiments, the constitutive promoter is a constitutive Lac promoter. In some embodiments, the constitutive promoter is selected from the constitutive promoters shown in Table 7.

In some embodiments, the second promoter is appropriate for use in a prokaryotic system. In some embodiments, the second promoter is appropriate for use in a bacterial (e.g., *E. coli*) system. In some embodiments, the second promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the second promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the second promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a pSC101, pMB1, pBR322, ColE1, or p15A origin of replication sequence. In some embodiments, the origin of replication comprises a pSC101 origin of replication sequence. In some embodiments, the origin of replication sequence comprises an origin of replication sequence shown in Table 3.

In some embodiments, the napDNAbp is a RNA-programmable DNA binding protein. In some embodiments, the napDNAbp is a nuclease active napDNAbp capable of introducing a double-strand break. In some embodiments, the RNA-programmable DNA binding protein is a Cas9 domain, a Cpf1 domain, a CasX domain, a CasY domain, a C2c1 domain, a C2c2 domain, or a C2c3 domain. In some embodiments, the RNA-programmable DNA binding protein is a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease active Cas9 domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain comprises the amino acid sequence provided in any one of SEQ ID NOs: 10-260. In some embodiments, the Cas9 domain comprises the amino acid sequence of SEQ ID NO: 10. In some embodiments, the Cas9 domain consists of the amino acid sequence provided in any one of SEQ ID NOs: 10-260. In some embodiments, the Cas9 domain consists of the amino acid sequence of SEQ ID NO: 10.

In some embodiments, the writing plasmid comprises: (i) a nucleic acid sequence encoding a napDNAbp operably linked to an inducible promoter, (ii) a nucleic acid sequence encoding a sgRNA operably linked to a constitutive promoter, wherein the sgRNA is complementary to a target sequence, and (iii) an origin of replication. In some embodiments, the sgRNA is constitutively expressed. In some embodiments, the sgRNA associates with the napDNAbp under conditions (e.g., a stimulus) that induce the expression of the napDNAbp. In some embodiments, the inducible promoter is an anhydrotetracycline-inducible promoter. In some embodiments, the constitutive promoter is a constitutive Lac promoter.

In some embodiments, the writing plasmid comprises: (i) a nucleic acid sequence encoding a Cas9 domain operably linked to a constitutive promoter, (ii) a nucleic acid sequence encoding a sgRNA operably linked to an inducible promoter, wherein the sgRNA is complementary to a target sequence, and (iii) an origin of replication. In some embodiments, the sgRNA associates with the napDNAbp under conditions (e.g., a stimulus) that induce the expression of the sgRNA.

In some embodiments, the writing plasmid comprises: (i) a nucleic acid sequence encoding a napDNAbp operably linked to a first inducible promoter, (ii) a nucleic acid sequence encoding a sgRNA operably linked to a second inducible promoter, wherein the sgRNA is complementary to a target sequence, and (iii) an origin of replication. In some embodiments, the sgRNA associates with the napDNAbp under conditions (e.g., a stimulus) that induce the expression of the sgRNA and the expression of the napDNAbp. In some embodiments, the first inducible promoter is an anhydrotetracycline-inducible promoter. In some embodiments, the second inducible promoter is an IPTG-promoter.

In some embodiments, the napDNAbp is a RNA-programmable DNA binding protein. In some embodiments, the napDNAbp is a nuclease active napDNAbp capable of introducing a double-strand break. In some embodiments, the RNA-programmable DNA binding protein is a Cas9 domain, a Cpf1 domain, a CasX domain, a CasY domain, a C2c1 domain, a C2c2 domain, or a C2c3 domain. In some embodiments, the RNA-programmable DNA binding protein is a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease active Cas9 domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain comprises the amino acid sequence provided in any one of SEQ ID NOs: 10-260. In some embodiments, the Cas9 domain comprises the amino acid sequence of SEQ ID NO: 10. In some embodiments, the Cas9 domain consists of the amino acid sequence provided in any one of SEQ ID NOs: 10-260. In some embodiments, the Cas9 domain consists of the amino acid sequence of SEQ ID NO: 10.

In yet another aspect, provided herein are writing plasmids comprising: (i) a nucleic acid sequence encoding a nucleic acid programmable DNA binding protein (napDNAbp) operably linked to a first promoter; (ii) a nucleic acid sequence encoding a first single guide RNA (sgRNA) operably linked to a second promoter; (iii) a nucleic acid sequence encoding a second single guide RNA (sgRNA) operably linked to a third promoter; and (iii) an origin of replication.

In some embodiments, the first sgRNA associates with the napDNAbp under conditions (e.g., a stimulus or set of stimuli) that induce the expression of the first sgRNA and expression of the napDNAbp. In some embodiments, the first sgRNA is complementary to a target sequence. In some embodiments, the writing plasmid does not encode a first sgRNA. In some embodiments, the napDNAbp encoded by the writing plasmid associates with a first sgRNA expressed by a cell. In some embodiments, the napDNAbp associates with a first sgRNA under conditions (e.g., a stimulus) that induce the expression of the napDNAbp, wherein the first sgRNA is expressed by a cell. In some embodiments, the second sgRNA associates with the napDNAbp under conditions (e.g., a stimulus or set of stimuli) that induce the expression of the second sgRNA and expression of the napDNAbp. In some embodiments, the second sgRNA is complementary to a target sequence. In some embodiments, the first and the second sgRNA are not complementary to the same target sequence. In some embodiments, the writing plasmid does not encode a second sgRNA. In some embodiments, the napDNAbp encoded by the writing plasmid associates with a second sgRNA expressed by a cell. In some embodiments, the napDNAbp associates with a second sgRNA under conditions (e.g., a stimulus) that induce the expression of the napDNAbp, wherein the second sgRNA is expressed by a cell.

In some embodiments, at least one of the promoters is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, at least one of the promoters is an inducible promoter. In some embodiments, at least one of the promoters is a constitutive promoter. In some embodiments, the first promoter, the second promoter, and the third promoter are different promoters. In some embodiments, the first promoter, the second promoter, and the third promoter are different inducible promoters.

In some embodiments, the first promoter is appropriate for use in a prokaryotic system. In some embodiments, the first promoter is appropriate for use in a bacterial (e.g., E. coli) system. In some embodiments, the first promoter is induced by the presence of a stimulus. In some embodiments, the stimulus is a small molecule, a protein, a peptide, an amino acid, a metabolite, a sugar, a molecule produced during the activation of an endogenous or exogenous signaling cascade, light, heat, mechanical stress, or a virus (e.g., phage). In some embodiments, the stimulus is anhydrotetracycline, IPTG, rhamnose, arabinose, tanespimycin, tunicamycin, or doxycycline. In some embodiments, the first promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the first promoter is a constitutive promoter. In some embodiments, the constitutive promoter is a constitutive Lac promoter. In some embodiments, the constitutive promoter is selected from the constitutive promoters shown in Table 7.

In some embodiments, the second promoter is appropriate for use in a prokaryotic system. In some embodiments, the second promoter is appropriate for use in a bacterial (e.g., E. coli) system. In some embodiments, the second promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the second promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the second promoter is a constitutive promoter. In some embodiments, the constitutive promoter is a constitutive Lac promoter. In some embodiments, the constitutive promoter is selected from the constitutive promoters shown in Table 7.

In some embodiments, the third promoter is appropriate for use in a prokaryotic system. In some embodiments, the third promoter is appropriate for use in a bacterial (e.g., E. coli) system. In some embodiments, the third promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the third promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the third promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a pSC101, pMB1, pBR322, ColE1, or p15A origin of replication sequence. In some embodiments, the origin of replication comprises a pSC101 origin of replication sequence. In some embodiments, the origin of replication sequence comprises an origin of replication sequence shown in Table 3.

In some embodiments, the writing plasmid comprises: (i) a nucleic acid sequence encoding a napDNAbp operably linked to a first inducible promoter, (ii) a nucleic acid sequence encoding a first sgRNA operably linked to a second inducible promoter, wherein the first sgRNA is complementary to a target sequence, (iii) a nucleic acid sequence encoding a second sgRNA operably linked to a third inducible promoter, wherein the second sgRNA is complementary to a target sequence, and (iv) an origin of replication. In some embodiments, the first sgRNA associates with the napDNAbp only under conditions (e.g., a stimulus or set of stimuli) that induce the expression of the first sgRNA and expression of the napDNAbp. In some embodiments, the second sgRNA associates with the napDNAbp only under conditions (e.g., a stimulus or set of stimuli) that induce the expression of the second sgRNA and expression of the napDNAbp. In some embodiments, the first inducible promoter is an anhydrotetracycline-inducible promoter. In some embodiments, the second inducible promoter is an IPTG-inducible promoter. In some embodiments, the third inducible promoter is a rhamnose-inducible promoter.

In some embodiments, the napDNAbp is a RNA-programmable DNA binding protein. In some embodiments, the napDNAbp is a nuclease active napDNAbp capable of introducing a double-strand break. In some embodiments, the RNA-programmable DNA binding protein is a Cas9 domain, a Cpf1 domain, a CasX domain, a CasY domain, a C2c1 domain, a C2c2 domain, or a C2c3 domain. In some embodiments, the RNA-programmable DNA binding protein is a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease active Cas9 domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain comprises the amino acid sequence provided in any one of SEQ ID NOs: 10-260. In some embodiments, the Cas9 domain comprises the amino acid sequence of SEQ ID NO: 10. In some embodiments, the Cas9 domain consists of the amino acid sequence provided in any one of SEQ ID NOs: 10-260. In some embodiments, the Cas9 domain consists of the amino acid sequence of SEQ ID NO: 10.

In some embodiments, any of the writing plasmids described above may be used in a prokaryotic cell. In some embodiments, any of the writing plasmids described above may be used in a bacterial cell. In some embodiments, the bacterial cell is an *E. coli* cell.

One of ordinary skill in the art will recognize based on this disclosure and knowledge in the field that additional promoters operably linked to additional sgRNA sequences, or additional napDNAbps (e.g., an orthogonal Cas9 domain) operably linked to additional promoters, can be included in each of the writing plasmids for use in a prokaryotic system (e.g., a prokaryotic cell) described above, and thus the disclosure in not limited in that regard. In some embodiments, the prokaryotic system is a bacterial system (e.g., a bacterial cell). In some embodiments, the bacterial system is an *E. coli* system (e.g., an *E coli* cell).

Some aspects of the present disclosure provide writing plasmids comprising a nucleic acid sequence encoding fusion protein comprising a nucleic acid programmable DNA binding protein (napDNAbp) and a nucleic acid editing domain operably linked to a promoter. In some embodiments, the napDNAbp is a nuclease inactive napDNAbp that does not introduce a single-strand or double-strand break. Without wishing to be bound by any particular theory, the components of the writing plasmid (e.g., fusion protein) are generally operably linked to a promoter sequence which controls the expression of each component (see, e.g., FIG. 3). In some embodiments, the components of the writing plasmid (e.g., fusion protein, sgRNA) are operably linked to a single inducible promoter, such that the presence of the stimulus (e.g., small molecule, antibiotic, metabolite, protein, peptide, heat, light, etc.) induces expression of all the components of the writing plasmid simultaneously. In some embodiments, one or more of the components of the writing plasmid (e.g., fusion protein, sgRNA) are operably linked to a constitutively active promoter, such that the component is constitutively expressed in cells. In some embodiments, each component of the writing plasmid (e.g., fusion protein, sgRNA) is operably linked to a different inducible promoter, where expression of each component is only initiated in the presence of the correct set of stimuli (e.g., small molecule, antibiotic, metabolite, sugar, protein, peptide, amino acid, molecule produced during an activated endogenous or exogenous signaling cascade, light, heat, virus, etc). The use of multiple different inducible promoters operably linked to separate components of the writing plasmid allows for the generation of cell data recorders that recapitulate an "AND" Boolean logic gate, where signal output (e.g., DNA double-strand breaks) is only recorded in the presence of all required stimuli, but not in the presence of only one stimulus (see, e.g., FIG. 4). These writing plasmids may be used in both prokaryotic (e.g., bacterial, e.g., *E. coli*) and eukaryotic (e.g., mammalian, e.g., human) systems, with the necessary attention to selecting appropriate promoters and ORI sequences for the desired system application.

Thus, in one aspect, provided herein are writing plasmids for use in prokaryotic cells comprising (i) a nucleic acid sequence encoding a fusion protein comprising a nucleic acid programmable DNA binding protein (napDNAbp) and a nucleic acid editing domain operably linked to a promoter; and (ii) an origin of replication.

In some embodiments, the writing plasmid does not encode a sgRNA. In some embodiments, the napDNAbp of the fusion protein encoded by the writing plasmid associates with a sgRNA expressed by a cell. In some embodiments, the napDNAbp of the fusion protein associates with a sgRNA under conditions (e.g., a stimulus) that induce the expression of the fusion protein, wherein the sgRNA is expressed by a cell. In some embodiments, the sgRNA is complementary to a target sequence.

In some embodiments, the promoter is appropriate for use in a prokaryotic system. In some embodiments, the promoter is appropriate for use in a bacterial (e.g., *E. coli*) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a CloDF13, CloE1, pSC101, pMB1, pBR322, ColE1, or p15A origin of replication sequence. In some embodiments, the origin of replication comprises a pSC101 origin of replication sequence. In some embodiments, the origin of replication comprises a CloDF13 origin of replication sequence. In some embodiments, the origin of replication comprises a CloE1 origin of replication sequence. In some embodiments, the origin of replication sequence comprises an origin of replication sequence shown in Table 3.

In some embodiments, the napDNAbp is a nuclease inactive napDNAbp that does not introduce a single-strand or double-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOS: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In another aspect, provided herein are writing plasmids for use in prokaryotic cells comprising (i) a nucleic acid sequence encoding (a) a fusion protein comprising a nucleic acid programmable DNA binding protein (napDNAbp) and a nucleic acid editing domain and (b) a single guide RNA (sgRNA), wherein the nucleic acid sequence of (i) is operably linked to a promoter; and (ii) an origin of replication.

In some embodiments, the sgRNA associates with the napDNAbp under conditions (e.g., a stimulus or set of stimuli) that induce the expression of the sgRNA and expression of the fusion protein. In some embodiments, the sgRNA is complementary to a target sequence. In some embodiments, the writing plasmid does not encode a sgRNA. In some embodiments, the napDNAbp of the fusion protein encoded by the writing plasmid associates with a sgRNA expressed by a cell. In some embodiments, the napDNAbp associates with a sgRNA under conditions (e.g., a stimulus) that induce the expression of the fusion protein, wherein the sgRNA is expressed by a cell.

In some embodiments, the promoter is appropriate for use in a prokaryotic system. In some embodiments, the promoter is appropriate for use in a bacterial (e.g., E. coli) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a CloDF13, CloE1, pSC101, pMB1, pBR322, ColE1, or p15A origin of replication sequence. In some embodiments, the origin of replication comprises a pSC101 origin of replication sequence. In some embodiments, the origin of replication comprises a CloDF13 origin of replication sequence. In some embodiments, the origin of replication comprises a CloE1 origin of replication sequence. In some embodiments, the origin of replication sequence comprises an origin of replication sequence shown in Table 3.

In some embodiments, the napDNAbp is a nuclease inactive napDNAbp that does not introduce a single-strand or double-strand break. In some embodiments, the napD-NAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from Streptococcus pyogenes (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins described herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In yet another aspect, provided herein are writing plasmids for use in prokaryotic cells comprising (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a single guide RNA (sgRNA) operably linked to a second promoter; and (iii) an origin of replication.

In some embodiments, the sgRNA associates with the napDNAbp under conditions (e.g., a stimulus or set of stimuli) that induce the expression of the sgRNA and expression of the fusion protein. In some embodiments, the sgRNA is complementary to a target sequence. In some embodiments, the writing plasmid does not encode a sgRNA. In some embodiments, the napDNAbp encoded by the writing plasmid associates with a sgRNA expressed by a cell. In some embodiments, the napDNAbp associates with a sgRNA under conditions (e.g., a stimulus) that induce the expression of the fusion protein, wherein the sgRNA is expressed by a cell.

In some embodiments, at least one of the promoters is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, at least one of the promoters is an inducible promoter. In some embodiments, at least one of the promoters is a constitutive promoter. In some embodiments, the first promoter and the second promoter are different promoters. In some embodiments, the first promoter and the second promoter are different inducible promoters.

In some embodiments, the first promoter is appropriate for use in a prokaryotic system. In some embodiments, the first promoter is appropriate for use in a bacterial (e.g., E. coli) system. In some embodiments, the first promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the first promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the first promoter is a constitutive promoter. In some embodiments, the constitutive promoter is a constitutive Lac promoter. In some embodiments, the constitutive promoter is selected from the constitutive promoters shown in Table 7.

In some embodiments, the second promoter is appropriate for use in a prokaryotic system. In some embodiments, the second promoter is appropriate for use in a bacterial (e.g., E. coli) system. In some embodiments, the second promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the second promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the second promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a CloDF13, CloE1, pSC101, pMB1, pBR322, ColE1, or p15A origin of replication sequence. In some embodiments, the origin of replication comprises a pSC101 origin of replication sequence. In some embodiments, the origin of replication comprises a CloDF13 origin of replication sequence. In some embodiments, the origin of replication comprises a CloE1 origin of replication sequence. In some embodiments, the origin of replication sequence comprises an origin of replication sequence shown in Table 3.

In some embodiments, the writing plasmid comprises: (i) a nucleic acid sequence encoding a fusion protein comprising a napDNAbp and a nucleic acid editing domain operably linked to a constitutive promoter, (ii) a nucleic acid sequence encoding a sgRNA operably linked to an inducible promoter, wherein the sgRNA is complementary to a target sequence, and (iii) an origin of replication. In some embodiments, the fusion protein is constitutively expressed. In some embodiments, the sgRNA associates with the napDNAbp under conditions (e.g., a stimulus) that induce the expression of the sgRNA, wherein the napDNAbp is constitutively expressed. In some embodiments, the inducible promoter is an anhydrotetracycline-inducible promoter. In some embodiments, the constitutive promoter is a constitutive Lac promoter.

In some embodiments, the writing plasmid comprises: (i) a nucleic acid sequence encoding a fusion protein comprising a napDNAbp and a nucleic acid editing domain operably linked to an inducible promoter, (ii) a nucleic acid sequence encoding a sgRNA operably linked to a constitutive promoter, wherein the sgRNA is complementary to a target sequence, and (iii) an origin of replication. In some embodiments, the sgRNA is constitutively expressed. In some embodiments, the sgRNA associates with the napDNAbp under conditions (e.g., a stimulus) that induce the expression of the fusion protein. In some embodiments, the inducible promoter is an anhydrotetracycline-inducible promoter. In some embodiments, the constitutive promoter is a constitutive Lac promoter.

In some embodiments, the writing plasmid comprises: (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is an IPTG-inducible promoter.

In some embodiments, the writing plasmid comprises: (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is an arabinose-inducible promoter.

In some embodiments, the writing plasmid comprises: (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is a rhamnose-inducible promoter.

In some embodiments, the writing plasmid comprises: (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is a phage shock promoter (PSP). In some embodiments, expression of the sgRBA is induced by the presence of a phage.

In some embodiments, the writing plasmid comprises: (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication. In some embodiments, the sgRNA associates with the napDNAbp only under conditions (e.g., a stimulus or set of stimuli) that induce the expression of the fusion protein and expression of the sgRNA. In some embodiments, the first inducible promoter is a light-inducible promoter. In some embodiments, expression of the fusion protein is induced in the presence of light, wherein the light inhibits the binding of a repressor to the first inducible promoter. In some embodiments, the second inducible promoter is an IPTG-inducible promoter.

In some embodiments, the napDNAbp is a nuclease inactive napDNAbp that does not introduce a single-strand or double-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In yet another aspect, provided herein are writing plasmids for use in prokaryotic systems comprising (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a first single guide RNA (sgRNA) operably linked to a second promoter; (iii) a nucleic acid sequence encoding a second single guide RNA (sgRNA) operably linked to a third promoter; and (iv) an origin of replication.

In some embodiments, the first sgRNA associates with the napDNAbp under conditions (e.g., a stimulus or set of stimuli) that induce the expression of the first sgRNA and expression of the fusion protein. In some embodiments, the first sgRNA is complementary to a target sequence. In some embodiments, the writing plasmid does not encode a first sgRNA. In some embodiments, the napDNAbp encoded by the writing plasmid associates with a first sgRNA expressed by a cell. In some embodiments, the napDNAbp associates with a first sgRNA under conditions (e.g., a stimulus) that induce the expression of the fusion protein, wherein the first sgRNA is expressed by a cell. In some embodiments, the second sgRNA associates with the napDNAbp under conditions (e.g., a stimulus or set of stimuli) that induce the expression of the second sgRNA and expression of the fusion protein. In some embodiments, the second sgRNA is complementary to a target sequence. In some embodiments, the first and the second sgRNA are not complementary to the same target sequence. In some embodiments, the writing plasmid does not encode a second sgRNA. In some embodiments, the napDNAbp encoded by the writing plasmid associates with a second sgRNA expressed by a cell. In some embodiments, the napDNAbp associates with a second sgRNA under conditions (e.g., a stimulus) that induce the expression of the fusion protein, wherein the second sgRNA is expressed by a cell.

In some embodiments, at least one of the promoters is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, at least one of the promoters is an inducible promoter. In some embodiments, at least one of the promoters is a constitutive promoter. In some embodiments, the first promoter, the second promoter, and the third promoter are different promoters. In some embodiments, the first promoter, the second promoter, and the third promoter are different inducible promoters.

In some embodiments, the first promoter is appropriate for use in a prokaryotic system. In some embodiments, the first promoter is appropriate for use in a bacterial (e.g., E. coli) system. In some embodiments, the first promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the first promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the first promoter is a constitutive promoter. In some embodiments, the constitutive promoter is a constitutive Lac promoter. In some embodiments, the constitutive promoter is selected from the constitutive promoters shown in Table 7.

In some embodiments, the second promoter is appropriate for use in a prokaryotic system. In some embodiments, the second promoter is appropriate for use in a bacterial (e.g., *E. coli*) system. In some embodiments, the second promoter is induced by the presence of a stimulus. In some embodiments, the stimulus is a small molecule, a protein, a peptide, an amino acid, a metabolite, a sugar, a molecule produced during the activation of an endogenous or exogenous signaling cascade, light, heat, mechanical stress, or a virus (e.g., phage). In some embodiments, the stimulus is anhydrotetracycline, IPTG, rhamnose, arabinose, tanespimycin, tunicamycin, or doxycycline. In some embodiments, the second promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the second promoter is a constitutive promoter. In some embodiments, the constitutive promoter is a constitutive Lac promoter. In some embodiments, the constitutive promoter is selected from the constitutive promoters shown in Table 7.

In some embodiments, the third promoter is appropriate for use in a prokaryotic system. In some embodiments, the third promoter is appropriate for use in a bacterial (e.g., *E. coli*) system. In some embodiments, the third promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the third promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the third promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a CloDF13, CloE1, pSC101, pMB1, pBR322, ColE1, or p15A origin of replication sequence. In some embodiments, the origin of replication comprises a pSC101 origin of replication sequence. In some embodiments, the origin of replication comprises a CloDF13 origin of replication sequence. In some embodiments, the origin of replication comprises a CloE1 origin of replication sequence. In some embodiments, the origin of replication sequence comprises an origin of replication sequence shown in Table 3.

In some embodiments, the writing plasmid comprises: (i) a nucleic acid sequence encoding a fusion protein comprising a napDNAbp and a nucleic acid editing domain operably linked to a first inducible promoter, (ii) a nucleic acid sequence encoding a first sgRNA operably linked to a second inducible promoter, wherein the first sgRNA is complementary to a target sequence, (iii) a nucleic acid sequence encoding a second sgRNA operably linked to a third inducible promoter, wherein the second sgRNA is complementary to a target sequence, and (iv) an origin of replication. In some embodiments, the first sgRNA associates with the napDNAbp only under conditions (e.g., a stimulus or set of stimuli) that induce the expression of the fusion protein and the expression of the first sgRNA. In some embodiments, the second sgRNA associates with the napDNAbp only under conditions (e.g., a stimulus or set of stimuli) that induce the expression of the fusion protein and the expression of the second sgRNA. In some embodiments, the first inducible promoter is an anhydrotetracycline-inducible promoter. In some embodiments, the second inducible promoter is an arabinose-inducible promoter. In some embodiments, the third inducible promoter is a rhamnose-inducible promoter.

In some embodiments, the napDNAbp is a nuclease inactive napDNAbp that does not introduce a single-strand or double-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from Streptococcus pyogenes (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOS: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins described herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In yet another aspect, provided herein are writing plasmids for use in prokaryotic systems comprising: (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a first single guide RNA (sgRNA) operably linked to a second promoter; (iii) a nucleic acid sequence encoding a second single guide RNA (sgRNA) operably linked to a third promoter; (iv) a nucleic acid sequence encoding a third single guide RNA (sgRNA) operably linked to a fourth promoter; and (iv) an origin of replication.

In some embodiments, the first sgRNA associates with the napDNAbp under conditions (e.g., a stimulus or set of stimuli) that induce the expression of the first sgRNA and expression of the fusion protein. In some embodiments, the first sgRNA is complementary to a target sequence. In some embodiments, the writing plasmid does not encode a first sgRNA. In some embodiments, the napDNAbp encoded by the writing plasmid associates with a first sgRNA expressed by a cell. In some embodiments, the napDNAbp associates with a first sgRNA under conditions (e.g., a stimulus) that induce the expression of the fusion protein, wherein the first sgRNA is expressed by a cell. In some embodiments, the second sgRNA associates with the napDNAbp under conditions (e.g., a stimulus or set of stimuli) that induce the expression of the second sgRNA and expression of the fusion protein. In some embodiments, the second sgRNA is complementary to a target sequence. In some embodiments, the first and the second sgRNA are not complementary to the same target sequence. In some embodiments, the writing plasmid does not encode a second sgRNA. In some embodiments, the napDNAbp encoded by the writing plasmid associates with a second sgRNA expressed by a cell. In some embodiments, the napDNAbp associates with a second sgRNA under conditions (e.g., a stimulus) that induce the expression of the fusion protein, wherein the second sgRNA is expressed by a cell. In some embodiments, the third sgRNA associates with the napDNAbp under conditions (e.g., a stimulus or set of stimuli) that induce the expression of the third sgRNA and expression of the fusion protein. In some embodiments, the third sgRNA is complementary to a target sequence. In some embodiments, the first, the second, and the third sgRNA are not complementary to the same target sequence. In some embodiments, the writing plasmid does not encode a third sgRNA. In some embodiments, the napDNAbp encoded by the writing plasmid associates with a third sgRNA expressed by a cell. In some embodiments, the napDNAbp associates with a third sgRNA under conditions (e.g., a stimulus) that induce the expression of the fusion protein, wherein the third sgRNA is expressed by a cell.

In some embodiments, at least one of the promoters is induced by the presence of a stimulus. In some embodiments, the stimulus is a small molecule, a protein, a peptide, an amino acid, a metabolite, a sugar, a molecule produced during the activation of an endogenous or exogenous signaling cascade, light, heat, mechanical stress, or a virus (e.g., phage). In some embodiments, the stimulus is anhydrotetracycline, IPTG, rhamnose, arabinose, tanespimycin, tunicamycin, or doxycycline. In some embodiments, at least one of the promoters is an inducible promoter. In some embodiments, at least one of the promoters is a constitutive promoter. In some embodiments, the first promoter, the second promoter, the third promoter, and the fourth promoter are different promoters. In some embodiments, the first promoter, the second promoter, the third promoter, and the fourth promoter are different inducible promoters.

In some embodiments, the first promoter is appropriate for use in a prokaryotic system. In some embodiments, the first promoter is appropriate for use in a bacterial (e.g., *E. coli*) system. In some embodiments, the first promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the first promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an anhydrotetracycline-inducible promoter. In some embodiments, the inducible promoter is selected from the inducible promoters shown in Table 7. In some embodiments, the first promoter is a constitutive promoter. In some embodiments, the constitutive promoter is a constitutive Lac promoter. In some embodiments, the constitutive promoter is selected from the constitutive promoters shown in Table 7.

In some embodiments, the second promoter is appropriate for use in a prokaryotic system. In some embodiments, the second promoter is appropriate for use in a bacterial (e.g., *E. coli*) system. In some embodiments, the second promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the second promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the second promoter is a constitutive promoter. In some embodiments, the constitutive promoter is a constitutive Lac promoter. In some embodiments, the constitutive promoter is selected from the constitutive promoters shown in Table 7.

In some embodiments, the third promoter is appropriate for use in a prokaryotic system. In some embodiments, the third promoter is appropriate for use in a bacterial (e.g., *E. coli*) system. In some embodiments, the third promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the third promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the third promoter is a constitutive promoter. In some embodiments, the constitutive promoter is a constitutive Lac promoter. In some embodiments, the constitutive promoter is selected from the constitutive promoters shown in Table 7.

In some embodiments, the fourth promoter is appropriate for use in a prokaryotic system. In some embodiments, the fourth promoter is appropriate for use in a bacterial (e.g., *E. coli*) system. In some embodiments, the fourth promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is anhydrotetracycline, IPTG, rhamnose, arabinose, tanespimycin, tunicamycin, or doxycycline. In some embodiments, the fourth promoter is an inducible promoter. In some embodiments, the inducible promoter is an anhydrotetracycline-inducible promoter, IPTG-inducible promoter, rhamnose-inducible promoter, arabinose-inducible promoter, a tetracycline-inducible promoter, a light-inducible promoter, a heat-inducible promoter, or a phage shock promoter (PSP). In some embodiments, the inducible promoter is an IPTG-inducible promoter. In some embodiments, the inducible promoter is an arabinose-inducible promoter. In some embodiments, the inducible promoter is a rhamnose-inducible promoter. In some embodiments, the inducible promoter is selected from the inducible promoters shown in Table 7. In some embodiments, the fourth promoter is a constitutive promoter. In some embodiments, the constitutive promoter is a constitutive Lac promoter. In some embodiments, the constitutive promoter is selected from the constitutive promoters shown in Table 7.

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a CloDF13, CloE1, pSC101, pMB1, pBR322, ColE1, or p15A origin of replication sequence. In some embodiments, the origin of replication comprises a pSC101 origin of replication sequence. In some embodiments, the origin of replication comprises a CloDF13 origin of replication sequence. In some embodiments, the origin of replication comprises a CloE1 origin of replication sequence. In some embodiments, the origin of replication sequence comprises an origin of replication sequence shown in Table 3.

In some embodiments, the writing plasmid comprises: (i) a nucleic acid sequence encoding a fusion protein comprising a napDNAbp and a nucleic acid editing domain operably linked to a first inducible promoter, (ii) a nucleic acid sequence encoding a first sgRNA operably linked to a second inducible promoter, wherein the first sgRNA is complementary to a target sequence, (iii) a nucleic acid encoding a second sgRNA operably linked to a third inducible promoter, wherein the second sgRNA is complementary to a target sequence, (iv) a nucleic acid molecule encoding a third sgRNA operably linked to a fourth inducible promoter, wherein the third sgRNA is complementary to a target sequence, and (v) an origin of replication. In some embodiments, the first sgRNA associates with the napDNAbp only under conditions (e.g., a stimulus or set of stimuli) that induce the expression of the fusion protein and the first sgRNA. In some embodiments, the second sgRNA associates with the napDNAbp only under conditions (e.g., a stimulus or set of stimuli) that induce the expression of the fusion protein and the second sgRNA. In some embodiments, the third sgRNA associates with the napDNAbp only under conditions (e.g., a stimulus or set of stimuli) that the expression of the fusion protein and the third sgRNA. In some embodiments, the first inducible promoter is an anhydrotetracycline-inducible promoter. In some embodiments, the second inducible promoter is an IPTG-inducible promoter. In some embodiments, the third inducible promoter is an arabinose-inducible promoter. In some embodiments, and the fourth inducible promoter is a rhamnose-inducible promoter.

In some embodiments, the napDNAbp is a nuclease inactive napDNAbp that does not introduce a single-strand or double-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

One of ordinary skill in the art will recognize based on this disclosure and knowledge in the field that additional promoters operably linked to additional sgRNA sequences, or additional fusion proteins (e.g., comprising an orthogonal napDNAbp, such as an orthogonal Cas9 domain) operably linked to additional promoters, can be included in each of the writing plasmids for use in a prokaryotic system (e.g., a prokaryotic cell) described above, and thus the disclosure in not limited in that regard. In some embodiments, the prokaryotic system is a bacterial system (e.g., a bacterial cell). In some embodiments, the bacterial system is an *E. coli* system (e.g., an *E coli* cell).

In another aspect, provided herein are writing plasmids for use in eukaryotic cells comprising (i) a nucleic acid sequence encoding a fusion protein comprising a nucleic acid programmable DNA binding protein (napDNAbp) and a nucleic acid editing domain operably linked to a promoter; and (ii) an origin of replication.

In some embodiments, the writing plasmid does not encode a sgRNA. In some embodiments, the napDNAbp of the fusion protein encoded by the writing plasmid associates with a sgRNA expressed by a cell. In some embodiments, the napDNAbp of the fusion protein associates with a sgRNA under conditions (e.g., a stimulus) that induce the expression of the fusion protein, wherein the sgRNA is expressed by a cell. In some embodiments, the sgRNA is complementary to a target sequence.

In some embodiments, the promoter is appropriate for use in a eukaryotic system. In some embodiments, the promoter is appropriate for use in a mammalian (e.g., human) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signaling pathway. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, Signal Transducer and Activator of Transcription 1 (STAT1), STAT2, STAT3, interferon regulatory factor-1 (IRF-1), or E2F cascade. In some such embodiments, the stimulus is a cytokine or growth factor such as Tumor Necrosis Factor (TNF), Transforming Growth Factor β (TGF-β), Interleukin 6 (IL-6), Interferon α (IFNα), IFNγ, or Epidermal Growth Factor (EGF). In some embodiments, the endogenous signaling cascade is, for example, a cAMP Response Element-Binding protein (CREB), CCAAT-Enhancer-Binding protein (C/EBP), Serum Response Factor (SRF), Nuclear Factor of Activated T-cells (NFAT), Glucocorticoid Receptor (GR), Mitogen Activated Protein Kinase/c-Jun N-terminal Kinase (MAPK/JNK), GATA transcription factor (GATA), Retinoic Acid Receptor (RAR), Retinoid X Receptor (RXR), Vitamin D Receptor (VDR), Adenylate-Uridylate element (ARE), or a Xenobiotic/Dioxin-Responsive Element (XRE/DRE) cascade. In certain such embodiments the stimulus is a small molecule such as forskolin, lithium chloride (LiCl), phorbol 12-myristate 13-acetate (PMA), dexamethasone, all-trans retinoic acid (ATRA), calcitriol, sulforaphane, or 2,3,7,8-tetrachlorodibenzodioxin (TCDD). In some embodiments, the endogenous signaling cascade is a Heat Shock Factor (HSF), Activating Transcription Factor 6 (ATF6), or CCAAT-binding Factor/Nuclear Transcription Factor Y/Transcriptional Factor Yin Yang 1 (CBF/NF-Y/YY1) cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the origin of replication (ORI) comprises a nucleic acid sequence suitable for use in a eukaryotic system. In some embodiments, the origin of replication (ORI) comprises a eukaryotic origin of replication sequence. In some embodiments, the origin of replication comprises a CloE1 origin of replication sequence. In some embodiments, the origin of replication sequence comprises an origin of replication sequence shown in Table 3.

In some embodiments, the writing plasmid comprises: (i) a nucleic acid sequence encoding a fusion protein comprising a napDNAbp and a nucleic acid editing domain operably linked to a first constitutive promoter, and (ii) an origin of replication. In some embodiments, the fusion protein is constitutively expressed. In some embodiments, this writing plasmid is used in combination with a second plasmid comprising a nucleic acid encoding a first sgRNA operably liked to a second constitutive promoter, wherein the first sgRNA is complementary to a first target sequence. In some embodiments, the fusion protein and the first sgRNA are constitutively expressed, and the first sgRNA associates with the napDNAbp. In some embodiments, this writing plasmid is used in combination with a third plasmid comprising a nucleic acid encoding a second sgRNA operably liked to a third constitutive promoter, wherein the second sgRNA is complementary to a second target sequence. In some embodiments, the fusion protein and the second sgRNA are constitutively expressed, and the second sgRNA associates with the napDNAbp. In some embodiments, this writing plasmid is used in combination with a fourth plasmid comprising a nucleic acid encoding a third sgRNA operably liked to a fourth constitutive promoter, wherein the third sgRNA is complementary to a third target sequence. In some embodiments, the fusion protein and the third sgRNA are constitutively expressed, and the third sgRNA associates with the napDNAbp. In some embodiments, the first, second, and third sgRNAs are not identical. In some embodiments, the first, second, and third sgRNAs are each independently complementary to a different target sequence. In some embodiments, any one of the first, second, third, and/or fourth constitutive promoter is selected from the constitutive promoters listed in Table 8. In some embodiments, the first constitutive promoter is a CMV promoter. In some embodiments, the second, third, and/or fourth constitutive promoters are different. In some embodiments, the second, third, and/or fourth constitutive promoters are the same. In some embodiments, the second, third, and/or fourth constitutive promoter comprises a U6 promoter sequence. In some embodiments, any one of the first, second, third, and/or fourth promoters can be an inducible promoter. In some embodiments, the inducible promoter is selected from a inducible promoter listed in Table 8 or Table 10.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In another aspect, provided herein are writing plasmids for use in eukaryotic cells comprising (i) a nucleic acid sequence encoding (a) a fusion protein comprising a nucleic acid programmable DNA binding protein (napDNAbp) and a nucleic acid editing domain and (b) a single guide RNA (sgRNA), wherein the nucleic acid sequence of (i) is operably linked to a promoter; and (ii) an origin of replication.

In some embodiments, the sgRNA associates with the napDNAbp under conditions (e.g., a stimulus or set of stimuli) that induce the expression of the sgRNA and expression of the fusion protein. In some embodiments, the sgRNA is complementary to a target sequence. In some embodiments, the writing plasmid does not encode an sgRNA. In some embodiments, the napDNAbp of the fusion protein encoded by the writing plasmid associates with a sgRNA expressed by the cell. In some embodiments, the napDNAbp associates with a sgRNA under conditions (e.g., a stimulus) that induce the expression of the fusion protein, wherein the sgRNA is expressed by the cell.

In some embodiments, the promoter is appropriate for use in a eukaryotic system. In some embodiments, the promoter is appropriate for use in a mammalian (e.g., human) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signing cascade. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-ß, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the origin of replication (ORI) comprises a nucleic acid sequence suitable for use in a eukaryotic system. In some embodiments, the origin of replication (ORI) comprises a eukaryotic origin of replication sequence. In some embodiments, the origin of replication comprises a CloE1 origin of replication sequence. In some embodiments, the origin of replication sequence comprises an origin of replication sequence shown in Table 3.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOS: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In yet another aspect, provided herein are writing plasmids for use in eukaryotic cells comprising (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a single guide RNA (sgRNA) operably linked to a second promoter; and (iii) an origin of replication.

In some embodiments, the sgRNA associates with the napDNAbp under conditions (e.g., a stimulus or set of stimuli) that induce the expression of the sgRNA and expression of the fusion protein. In some embodiments, the sgRNA is complementary to a target sequence. In some embodiments, the writing plasmid does not encode a sgRNA. In some embodiments, the napDNAbp encoded by the writing plasmid associates with a sgRNA expressed by a cell. In some embodiments, the napDNAbp associates with a sgRNA under conditions (e.g., a stimulus) that induce the expression of the fusion protein, wherein the sgRNA is expressed by a cell.

In some embodiments, at least one of the promoters is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or an exogenous signaling cascade. In some embodiments, the stimulus is anhydrotetracycline, IPTG, rhamnose, arabinose, tanespimycin, tunicamycin, or doxycycline. In some embodiments, at least one of the promoters is an inducible promoter. In some embodiments, at least one of the promoters is a constitutive promoter. In some embodiments, the first promoter and the second promoter are different promoters. In some embodiments, the first promoter and the second promoter are different inducible promoters. In some embodiments, the first promoter and the second promoter are different constitutive promoters.

In some embodiments, the first promoter is appropriate for use in a eukaryotic system. In some embodiments, the promoter is appropriate for use in a mammalian (e.g., human) system. In some embodiments, the first promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signing cascade. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-ß, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the first promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the first promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the second promoter is appropriate for use in a eukaryotic system. In some embodiments, the promoter is appropriate for use in a mammalian (e.g., human) system. In some embodiments, the second promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signing cascade. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-ß, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the second promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the second promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the origin of replication (ORI) comprises a nucleic acid sequence suitable for use in a eukaryotic system. In some embodiments, the origin of replication (ORI) comprises a eukaryotic origin of replication sequence. In some embodiments, the origin of replication comprises a CloE1 origin of replication sequence. In some embodiments, the origin of replication sequence comprises an origin of replication sequence shown in Table 3.

In some embodiments, the writing plasmid comprises: (i) a nucleic acid sequence encoding a fusion protein comprising a napDNAbp and a nucleic acid editing domain operably linked to a constitutive promoter, (ii) a nucleic acid encoding a sgRNA operably liked to an inducible promoter, wherein the sgRNA is complementary to a target sequence, and (iii) an origin of replication. In some embodiments, the fusion protein is constitutively expressed and the napDNAbp associates with the sgRNA under conditions (e.g., a stimulus or set of stimuli) that induce the expression of the sgRNA.

In some embodiments, the writing plasmid comprises: (i) a nucleic acid sequence encoding a fusion protein comprising a napDNAbp and a nucleic acid editing domain operably linked to an inducible promoter, (ii) a nucleic acid encoding a sgRNA operably liked to a constitutive promoter, wherein the sgRNA is complementary to a target sequence, and (iii) an origin of replication. In some embodiments, the sgRNA is constitutively expressed and associates with the napDNAbp under conditions (e.g., a stimulus or set of stimuli) that induce the expression of the fusion protein. In some embodiments, the inducible promoter is a tetracycline-inducible promoter. In some embodiments, the stimulus that induces the expression of the fusion protein is doxycycline. In some embodiments, the constitutive promoter is a constitutive U6 promoter.

In some embodiments, the writing plasmid comprises: (i) a nucleic acid sequence encoding a fusion protein comprising a napDNAbp and a nucleic acid editing domain operably linked to an inducible promoter, (ii) a nucleic acid encoding a sgRNA operably liked to a constitutive promoter, wherein the sgRNA is complementary to a target sequence, and (iii) an origin of replication. In some embodiments, the sgRNA is constitutively expressed and associates with the napDNAbp under conditions (e.g., a stimulus or set of stimuli) that induce the expression of the fusion protein. In some embodiments, the inducible promoter is induced by a signaling molecule produced during the activation of an endogenous or an exogenous signaling cascade. In some embodiments, the endogenous signaling cascade is the Wnt signaling cascade. In some embodiments, the signaling molecule produced during an activated Wnt signaling cascade is beta-catenin. In some embodiments, the stimulus that induces the expression of the fusion protein is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-β, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the constitutive promoter is a constitutive U6 promoter. In some embodiments, the nucleic acid sequence of (i) or (ii) further comprises a nucleic acid sequence encoding a second protein. In some embodiments, the nucleic acid sequence of (i) further comprises a nucleic acid sequence encoding a second protein. In some embodiments, the second protein is luciferase. In some embodiments, the nucleic acid sequence encoding the reporter protein is connected to the 3' end of the nucleic acid sequence of (i) by an intervening P2A sequence.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

Some aspects of the present disclosure provide a writing plasmid for use with one or more additional plasmids (e.g., accessory plasmids) that employ both an inducible promoter and a repressor system for control of the expression of one or more components of the writing plasmid (e.g., napDNAbp, fusion protein, sgRNA). Without wishing to be bound by any particular theory, this combination of repressors and inducible promoters can allow for the recording of multiple inputs (e.g., stimuli) in an order-dependent manner.

Thus, in one aspect, provided herein are writing plasmids for use in a eukaryotic cell comprising: (i) a nucleic acid sequence encoding a fusion protein comprising a nucleic acid programmable DNA binding protein (napDNAbp) and a nucleic acid editing domain operably linked to a promoter; and (ii) an origin of replication.

In some embodiments, the writing plasmid does not encode a sgRNA. In some embodiments, the napDNAbp of the fusion protein encoded by the writing plasmid associates with a sgRNA expressed by a cell. In some embodiments, the napDNAbp of the fusion protein associates with a sgRNA under conditions (e.g., a stimulus) that induce the expression of the fusion protein, wherein the sgRNA is expressed by a cell. In some embodiments, the sgRNA is complementary to a target sequence.

In some embodiments, the promoter is appropriate for use in a eukaryotic system. In some embodiments, the promoter is appropriate for use in a mammalian (e.g., human) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signing pathway. In some embodiments, the endogenous signaling cascade is the Wnt signaling cascade. In some embodiments, the molecule produced during the activation of the Wnt signaling cascade (i.e., the stimulus) is beta-catenin. In certain embodiments, the signaling cascade is, for example, an NF-κB, SMADs, STAT1, STAT2, STAT3, IRF-1, or E2F cascade. In some such embodiments, the stimulus is a cytokine or growth factor such as TNF, TGF-ß, IL-6, IFNα, IFNγ, or EGF. In some embodiments, the signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8 or Table 10. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the origin of replication (ORI) comprises a nucleic acid sequence suitable for use in a eukaryotic system. In some embodiments, the origin of replication (ORI) comprises a eukaryotic origin of replication sequence. In some embodiments, the origin of replication comprises a CloE1 origin of replication sequence. In some embodiments, the origin of replication sequence comprises an origin of replication sequence shown in Table 3.

In some embodiments, the writing plasmid is used in combination with one or more additional plasmids. In some embodiments, the writing plasmid is used in combination with (i) a second plasmid comprising a nucleic acid sequence encoding a sgRNA operably linked to a constitutive promoter comprising a repressor binding site, wherein the sgRNA is complementary to a target sequence; and (ii) a third plasmid comprising a nucleic acid sequence encoding one or more repressor proteins operably linked to a second constitutive promoter. In some embodiments, the repressor protein and sgRNA are constitutively expressed, and the repressor protein binds to the repressor binding site of the constitutive promoter. In some embodiments, the nucleic acid sequence of (ii) encodes one repressor protein. In some embodiments, the repressor protein is a tetracycline repressor protein (TetR) or a lactose repressor protein (LacI). In some embodiments, the nucleic acid sequence of (ii) encodes a first repressor protein and a second repressor protein, wherein an intervening P2A sequence separates the nucleic acid sequences encoding the first and second repressor proteins. In some embodiments, the first repressor protein or the second repressor protein is a tetracycline repressor protein (TetR). In some embodiments, the first repressor protein or the second repressor protein is a lactose repressor protein (LacI). In some embodiments, the first repressor protein and the second repressor protein are not the same. In some embodiments, the first repressor protein is a lactose repressor protein (LacI). In some embodiments, the lactose repressor protein cannot bind to the first repressor binding site in the presence of IPTG. In some embodiments, the second repressor protein is a tetracycline repressor protein (TetR). In some embodiments, the tetracycline repressor protein cannot bind to the second repressor binding site in the presence of tetracycline, or a derivative thereof. In some embodiments, the tetracycline, or derivative thereof, is doxycycline. In some embodiments, the writing plasmid is used in combination with a fourth plasmid comprising a nucleic acid encoding a second sgRNA operably linked to a third constitutive promoter comprising a second repressor binding site, wherein the second sgRNA is complementary to a target sequence, wherein the second repressor protein and the second sgRNA are constitutively expressed, and wherein the second repressor protein binds to the second repressor binding site of the third constitutive promoter. In some embodiments, the first constitutive promoter, the second constitutive promoter, and the third constitutive promoter are selected from a CMV promoter, a U6 promoter, a H1 promoter, or a UBC promoter. In some embodiments, the first constitutive promoter, the second constitutive promoter, and the third constitutive promoter are selected from a constitutive promoter listed in Table 8. In some embodiments, the first constitutive promoter, the second constitutive promoter, and the third constitutive promoter are different constitutive promoters. In some embodiments, the first constitutive promoter is a U6 promoter. In some embodiments, the second constitutive promoter is a UBC promoter. In some embodiments, the third constitutive promoter is a H1 promoter.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

One of ordinary skill in the art will recognize based on this disclosure and knowledge in the field that additional promoters operably linked to additional sgRNA sequences, or additional fusion proteins (e.g., comprising an orthogonal napDNAbp, such as an orthogonal Cas9 domain) operably linked to additional promoters, can be included in each of the writing plasmids for use in a eukaryotic system (e.g., a eukaryotic cell) described above, and thus the disclosure in not limited in that regard. In some embodiments, the eukaryotic system is a mammalian system (e.g., a mammalian cell). In some embodiments, the mammalian system is a human system (e.g., a human cell).

Integrated Writing Systems

In one aspect, the present disclosure provides integrated writing systems comprising one or more writing loci comprising a nucleic acid sequence encoding a nucleic acid programmable DNA binding protein (napDNAbp) operably linked to a promoter. This napDNAbp may be a nuclease active napDNAbp (e.g., a nuclease active Cas9 domain) or a nuclease inactive napDNAbp (e.g., a dCas9 domain or a Cas9n domain). Without wishing to be bound by any particular theory, the components of the integrated writing system (e.g., napDNAbp) are generally operably linked to a promoter sequence which controls the expression of each component. In some embodiments, the components of the integrated writing system (e.g., napDNAbp) are operably linked to a single inducible promoter, such that the presence of the stimulus (e.g., a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism, etc.) induces expression of all the components of the writing locus simultaneously. In some embodiments, one or more of the components of the integrated writing system (e.g., napDNAbp) are operably linked to a constitutively active promoter, such that the component is constitutively expressed in cells. In some embodiments, each component of the integrated writing system (e.g., napDNAbp) is operably linked to a different inducible promoter, where expression of each component is only initiated in the presence of the correct set of stimuli (e.g., a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism, etc). The use of multiple different inducible promoters operably linked to separate components of the integrated writing system allows for the generation of cell data recorders that recapitulate an "AND" Boolean logic gate, where signal output (e.g., DNA double-strand breaks) is only recorded in the presence of all required stimuli, but not in the presence of only one stimulus.

In certain aspects, provided herein are integrated writing systems for use in eukaryotic cells comprising a writing locus comprising a nucleic acid sequence encoding a fusion protein comprising a nucleic acid programmable DNA binding protein (napDNAbp) and a nucleic acid editing domain operably linked to a promoter.

In some embodiments, the writing locus does not encode a sgRNA. In some embodiments, the napDNAbp of the fusion protein encoded by the writing locus associates with a sgRNA expressed by a cell (e.g., from a separate locus). In some embodiments, the napDNAbp of the fusion protein associates with a sgRNA under conditions (e.g., a stimulus) that induce the expression of the fusion protein, wherein the sgRNA is expressed by a cell. In some embodiments, the sgRNA is complementary to a target sequence.

In some embodiments, the promoter is appropriate for use in a eukaryotic system. In some embodiments, the promoter is appropriate for use in a mammalian (e.g., human) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signaling pathway. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, Signal Transducer and Activator of Transcription 1 (STAT1), STAT2, STAT3, interferon regulatory factor-1 (IRF-1), or E2F cascade. In some such embodiments, the stimulus is a cytokine or growth factor such as Tumor Necrosis Factor (TNF), Transforming Growth Factor β(TGF-β), Interleukin 6 (IL-6), Interferon α (IFNα), IFNγ, or Epidermal Growth Factor (EGF). In some embodiments, the endogenous signaling cascade is, for example, a cAMP Response Element-Binding protein (CREB), CCAAT-Enhancer-Binding protein (C/EBP), Serum Response Factor (SRF), Nuclear Factor of Activated T-cells (NFAT), Glucocorticoid Receptor (GR), Mitogen Activated Protein Kinase/c-Jun N-terminal Kinase (MAPK/JNK), GATA transcription factor (GATA), Retinoic Acid Receptor (RAR), Retinoid X Receptor (RXR), Vitamin D Receptor (VDR), Adenylate-Uridylate element (ARE), or a Xenobiotic/Dioxin-Responsive Element (XRE/DRE) cascade. In certain such embodiments the stimulus is a small molecule such as forskolin, lithium chloride (LiCl), phorbol 12-myristate 13-acetate (PMA), dexamethasone, all-trans retinoic acid (ATRA), calcitriol, sulforaphane, or 2,3,7,8-tetrachlorodibenzodioxin (TCDD). In some embodiments, the endogenous signaling cascade is a Heat Shock Factor (HSF), Activating Transcription Factor 6 (ATF6), or CCAAT-binding Factor/Nuclear Transcription Factor Y/Transcriptional Factor Yin Yang 1 (CBF/NF-Y/YY1) cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the writing locus comprises a nucleic acid sequence encoding a fusion protein comprising a napDNAbp and a nucleic acid editing domain operably linked to a first constitutive promoter. In some embodiments, the fusion protein is constitutively expressed. In some embodiments, this writing locus is used in combination with a second locus comprising a nucleic acid encoding a first sgRNA operably liked to a second constitutive promoter, wherein the first sgRNA is complementary to a first target sequence. In some embodiments, the fusion protein and the first sgRNA are constitutively expressed, and the first sgRNA associates with the napDNAbp. In some embodiments, this writing locus is used in combination with a third locus comprising a nucleic acid encoding a second sgRNA operably liked to a third constitutive promoter, wherein the second sgRNA is complementary to a second target sequence. In some embodiments, the fusion protein and the second sgRNA are constitutively expressed, and the second sgRNA associates with the napDNAbp. In some embodiments, this writing locus is used in combination with a fourth locus comprising a nucleic acid encoding a third sgRNA operably liked to a fourth constitutive promoter, wherein the third sgRNA is complementary to a third target sequence. In some embodiments, the fusion protein and the third sgRNA are constitutively expressed, and the third sgRNA associates with the napDNAbp. In some embodiments, the first, second, and third sgRNAs are not identical. In some embodiments, the first, second, and third sgRNAs are each independently complementary to a different target sequence. In some embodiments, any one of the first, second, third, and/or fourth constitutive promoter is selected from the constitutive promoters listed in Table 8. In some embodiments, the first constitutive promoter is a CMV promoter. In some embodiments, the second, third, and/or fourth constitutive promoters are different. In some embodiments, the second, third, and/or fourth constitutive promoters are the same. In some embodiments, the second, third, and/or fourth constitutive promoter comprises a U6 promoter sequence. In some embodiments, any one of the first, second, third, and/or fourth promoters can be an inducible promoter. In some embodiments, the inducible promoter is selected from a inducible promoter listed in Table 8 or Table 10.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In another aspect, provided herein are writing loci for use in eukaryotic cells comprising a first nucleic acid sequence encoding (a) a fusion protein comprising a nucleic acid programmable DNA binding protein (napDNAbp) and a nucleic acid editing domain and (b) a single guide RNA (sgRNA), wherein the first nucleic acid sequence of is operably linked to a promoter.

In some embodiments, the sgRNA associates with the napDNAbp under conditions (e.g., a stimulus or set of stimuli) that induce the expression of the sgRNA and expression of the fusion protein. In some embodiments, the sgRNA is complementary to a target sequence. In some embodiments, the writing locus does not encode an sgRNA. In some embodiments, the napDNAbp of the fusion protein encoded by the writing locus associates with a sgRNA expressed by the cell. In some embodiments, the napDNAbp associates with a sgRNA under conditions (e.g., a stimulus) that induce the expression of the fusion protein, wherein the sgRNA is expressed by the cell.

In some embodiments, the promoter is appropriate for use in a eukaryotic system. In some embodiments, the promoter is appropriate for use in a mammalian (e.g., human) system. In some embodiments, the promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signing cascade. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-ß, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOS: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

In yet another aspect, provided herein are writing loci for use in eukaryotic cells comprising (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a single guide RNA (sgRNA) operably linked to a second promoter; and (iii) an origin of replication.

In some embodiments, the sgRNA associates with the napDNAbp under conditions (e.g., a stimulus or set of stimuli) that induce the expression of the sgRNA and expression of the fusion protein. In some embodiments, the sgRNA is complementary to a target sequence. In some embodiments, the writing locus does not encode a sgRNA. In some embodiments, the napDNAbp encoded by the writing locus associates with a sgRNA expressed by a cell. In some embodiments, the napDNAbp associates with a sgRNA under conditions (e.g., a stimulus) that induce the expression of the fusion protein, wherein the sgRNA is expressed by a cell.

In some embodiments, at least one of the promoters is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or an exogenous signaling cascade. In some embodiments, the stimulus is anhydrotetracycline, IPTG, rhamnose, arabinose, tanespimycin, tunicamycin, or doxycycline. In some embodiments, at least one of the promoters is an inducible promoter. In some embodiments, at least one of the promoters is a constitutive promoter. In some embodiments, the first promoter and the second promoter are different promoters. In some embodiments, the first promoter and the second promoter are different inducible promoters. In some embodiments, the first promoter and the second promoter are different constitutive promoters.

In some embodiments, the first promoter is appropriate for use in a eukaryotic system. In some embodiments, the promoter is appropriate for use in a mammalian (e.g., human) system. In some embodiments, the first promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signing cascade. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-β, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the first promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the first promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the second promoter is appropriate for use in a eukaryotic system. In some embodiments, the promoter is appropriate for use in a mammalian (e.g., human) system. In some embodiments, the second promoter is induced by the presence of a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus (e.g., phage) or other microorganism. In some embodiments, the stimulus is a phage. In some embodiments, the stimulus is light. In some embodiments, the stimulus is a small molecule. In some embodiments, the stimulus is a sugar. In some embodiments, the stimulus is an antibiotic. In some embodiments, the stimulus is a molecule produced during the activation of an endogenous or exogenous signing cascade. In some embodiments, the endogenous signaling cascade is the Wnt signaling cascade. In some embodiments, the molecule produced during the activation of the Wnt signaling cascade (i.e., the stimulus) is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-β, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the stimulus is doxycycline. In some embodiments, the second promoter is an inducible promoter. In some embodiments, the inducible promoter is an inducible RNA polymerase III promoter, a tetracycline-inducible promoter, a light-inducible promoter, a heat-inducible promoter, a promoter induced by the presence of a virus, or a promoter induced by mechanical stress. In some embodiments, the inducible promoter is an tetracycline-inducible promoter. In some embodiments, the inducible RNA polymerase III promoter is an IPTG-inducible RNA polymerase III promoter or a tetracycline-inducible RNA polymerase III promoter. In some embodiments, the inducible promoter is selected from the inducible promoters shown in Table 8 or Table 10. In some embodiments, the second promoter is a constitutive promoter. In some embodiments, the constitutive promoter is a constitutive cytomegalovirus (CMV) promoter, a constitutive RNA polymerase III promoter, or a UBC promoter. In some embodiments, the constitutive promoter is selected from the constitutive promoters shown in Table 8. In some embodiments, the constitutive or the inducible promoter comprises a P2A sequence. In some embodiments, the constitutive or the inducible RNA polymerase III promoter comprises a U6 promoter sequence or an H1 promoter sequence.

In some embodiments, the integrated writing system comprises: (i) a nucleic acid sequence encoding a fusion protein comprising a napDNAbp and a nucleic acid editing domain operably linked to a constitutive promoter, and (ii) a nucleic acid encoding a sgRNA operably liked to an inducible promoter, wherein the sgRNA is complementary to a target sequence. In some embodiments, the fusion protein is constitutively expressed and the napDNAbp associates with the sgRNA under conditions (e.g., a stimulus or set of stimuli) that induce the expression of the sgRNA, wherein both nucleic acid sequences are integrated into the genome of a eukaryotic cell.

In some embodiments, the integrated writing system comprises: (i) a nucleic acid sequence encoding a fusion protein comprising a napDNAbp and a nucleic acid editing domain operably linked to an inducible promoter, and (ii) a nucleic acid encoding a sgRNA operably liked to a constitutive promoter, wherein the sgRNA is complementary to a target sequence, wherein both nucleic acid sequences are integrated into the genome of a eukaryotic cell. In some embodiments, the sgRNA is constitutively expressed and associates with the napDNAbp under conditions (e.g., a stimulus or set of stimuli) that induce the expression of the fusion protein. In some embodiments, the inducible promoter is a tetracycline-inducible promoter. In some embodiments, the stimulus that induces the expression of the fusion protein is doxycycline. In some embodiments, the constitutive promoter is a constitutive U6 promoter.

In some embodiments, the integrated writing system comprises: (i) a nucleic acid sequence encoding a fusion protein comprising a napDNAbp and a nucleic acid editing domain operably linked to an inducible promoter, and (ii) a nucleic acid encoding a sgRNA operably liked to a constitutive promoter, wherein the sgRNA is complementary to a target sequence, wherein both nucleic acid sequences are integrated into the genome of a eukaryotic cell. In some embodiments, the sgRNA is constitutively expressed and associates with the napDNAbp under conditions (e.g., a stimulus or set of stimuli) that induce the expression of the fusion protein. In some embodiments, the inducible promoter is induced by a signaling molecule produced during the activation of an endogenous or an exogenous signaling cascade. In some embodiments, the endogenous signaling cascade is the Wnt signaling cascade. In some embodiments, the signaling molecule produced during an activated Wnt signaling cascade is beta-catenin. In some embodiments, the stimulus that induces the expression of the fusion protein is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-ß, IL-6, IFNα, IFNγ, or EGF. In some embodiments, the endogenous signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the endogenous signaling cascade is an HSF, ATF6, or CBF/NF-Y/YY1 cascade. In some embodiments, the stimulus is anhydrotetracycline, IPTG, rhamnose, arabinose, tanespimycin, tunicamycin, or doxycycline. In some embodiments, the constitutive promoter is a constitutive U6 promoter. In some embodiments, the nucleic acid sequence of (i) or (ii) further comprises a nucleic acid sequence encoding a second protein. In some embodiments, the nucleic acid sequence of (i) further comprises a nucleic acid sequence encoding a second protein. In some embodiments, the second protein is luciferase. In some embodiments, the nucleic acid sequence encoding the reporter protein is connected to the 3' end of the nucleic acid sequence of (i) by an intervening P2A sequence.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

Some aspects of the present disclosure provide a writing locus for use with one or more additional loci (e.g., accessory loci) that employ both an inducible promoter and a repressor system for control of the expression of one or more components of the writing locus (e.g., napDNAbp, fusion protein, sgRNA). Without wishing to be bound by any particular theory, this combination of repressors and inducible promoters can allow for the recording of multiple inputs (e.g., stimuli) in an order-dependent manner.

In some embodiments, a writing locus of the integrated writing system is is used in combination with one or more additional loci. In some embodiments, the writing locus is used in combination with (i) a second locus comprising a nucleic acid sequence encoding a sgRNA operably linked to a constitutive promoter comprising a repressor binding site, wherein the sgRNA is complementary to a target sequence; and (ii) a third locus comprising a nucleic acid sequence encoding one or more repressor proteins operably linked to a second constitutive promoter. In some embodiments, the repressor protein and sgRNA are constitutively expressed, and the repressor protein binds to the repressor binding site of the constitutive promoter. In some embodiments, the nucleic acid sequence of (ii) encodes one repressor protein. In some embodiments, the repressor protein is a tetracycline repressor protein (TetR) or a lactose repressor protein (LacI). In some embodiments, the nucleic acid sequence of (ii) encodes a first repressor protein and a second repressor protein, wherein an intervening P2A sequence separates the nucleic acid sequences encoding the first and second repressor proteins. In some embodiments, the first repressor protein or the second repressor protein is a tetracycline repressor protein (TetR). In some embodiments, the first repressor protein or the second repressor protein is a lactose repressor protein (LacI). In some embodiments, the first repressor protein and the second repressor protein are not the same. In some embodiments, the first repressor protein is a lactose repressor protein (LacI). In some embodiments, the lactose repressor protein cannot bind to the first repressor binding site in the presence of IPTG. In some embodiments, the second repressor protein is a tetracycline repressor protein (TetR). In some embodiments, the tetracycline repressor protein cannot bind to the second repressor binding site in the presence of tetracycline, or a derivative thereof. In some embodiments, the tetracycline, or derivative thereof, is doxycycline. In some embodiments, the writing locus is used in combination with a fourth locus comprising a nucleic acid encoding a second sgRNA operably linked to a third constitutive promoter comprising a second repressor binding site, wherein the second sgRNA is complementary to a target sequence, wherein the second repressor protein and the second sgRNA are constitutively expressed, and wherein the second repressor protein binds to the second repressor binding site of the third constitutive promoter. In some embodiments, the first constitutive promoter, the second constitutive promoter, and the third constitutive promoter are selected from a CMV promoter, a U6 promoter, a H1 promoter, or a UBC promoter. In some embodiments, the first constitutive promoter, the second constitutive promoter, and the third constitutive promoter are selected from a constitutive promoter listed in Table 8. In some embodiments, the first constitutive promoter, the second constitutive promoter, and the third constitutive promoter are different constitutive promoters. In some embodiments, the first constitutive promoter is a U6 promoter. In some embodiments, the second constitutive promoter is a UBC promoter. In some embodiments, the third constitutive promoter is a H1 promoter.

In some embodiments, the napDNAbp is a napDNAbp capable of introducing a single-strand break. In some embodiments, the napDNAbp is a RNA-programmable DNA binding protein. In some embodiments, the RNA-programmable DNA binding protein comprises a Cas9 domain, a Cpf1 domain, a CasX domain, a CasY domain, a C2c1 domain, a C2c2 domain, or a C2c3 domain. In some embodiments, the RNA-programmable DNA binding protein comprises a Cas9 domain. In some embodiments, the Cas9 domain is a nuclease inactive Cas9 (dCas9) domain, a Cas9 nickase (Cas9n) domain, or a nuclease active Cas9 domain. In some embodiments, the Cas9 domain is a nuclease inactive dCas9 domain. In some embodiments, the Cas9 domain is a Cas9 nickase (Cas9n) domain. In some embodiments, the Cas9 domain is a Cas9 domain from *Streptococcus pyogenes* (spCas9). In some embodiments, the Cas9 domain comprises an amino acid sequence that is at least about 70% identical, at least about 80% identical, at least about 90%, at least about 95%, at least about 98%, at least about 99%, at least about 99.5%, or at least about 99.9% identical to the amino acid sequence provided in any one of SEQ ID NOs: 10-260. In some embodiments, the Cas9 domain is a dCas9 domain that comprises a D10A and a H840A mutation in the amino acid sequence provided by SEQ ID NO: 10, or a corresponding mutation in any one of SEQ ID NOs: 11-260. In some embodiments, the dCas9 domain comprises the amino acid sequence of SEQ ID NO: 6. In some embodiments, the Cas9 domain is a Cas9n domain that comprises a D10A or a H840A mutation in the amino acid sequence provided by SEQ ID NO: 10, or a corresponding mutation in any one of SEQ ID NOs: 11-260. In some embodiments, the Cas9 domain is a Cas9n domain that comprises a D10A mutation in the amino acid sequence provided by SEQ ID NO: 10, or a corresponding mutation in any one of SEQ ID NOs: 11-260. In some embodiments, the Cas9 domain comprises the amino acid sequence of SEQ ID NO: 7.

In some embodiments, the nucleic acid editing domain comprises a deaminase, a nuclease, a nickase, a recombinase, a methyltransferase, a methylase, an acetylase, an acetyltransferase, a transcriptional activator, or a transcriptional repressor domain. In some embodiments, the nucleic acid editing domain comprises a deaminase domain. In some embodiments, the deaminase domain is selected from any of the deaminase domains provided herein. In some embodiments, the deaminase domain is a cytidine deaminase domain. In some embodiments, the cytidine deaminase domain comprises the amino acid sequence of any one of SEQ ID NOs: 350-389. In some embodiments, the cytidine deaminase domain is a deaminase domain from the apolipoprotein B mRNA-editing complex (APOBEC) family. In some embodiments, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

In some embodiments, the fusion protein comprises any of the fusion proteins provided herein. In some embodiments, the fusion protein comprises a Cas9 domain and a cytidine deaminase domain. In some embodiments, the Cas9 domain and the cytidine deaminase are linked via a linker. In some embodiments, the linker comprises the amino acid sequence of any one of SEQ ID NOs: 300-318. In some embodiments, the linker comprises the amino acid sequence SGSETPGTSESATPES (SEQ ID NO: 306). In some embodiments, the fusion protein comprises the amino acid sequence of any one of SEQ ID NOs: 540-542. In some embodiments, the fusion protein further comprises a uracil glycosylase inhibitor (UGI) domain. In some embodiments, the fusion protein comprises the amino acid sequence of any one of SEQ ID NOs: 543-550. In some embodiments, the fusion protein comprises the amino acid sequence of SEQ ID NO: 543. In some embodiments, the fusion protein comprises the amino acid sequence of SEQ ID NO: 544. In some embodiments, the fusion protein comprises a Cas9 domain and one or more adenosine deaminase domains. In some embodiments, one or more of the adenosine deaminase domains comprise the amino acid sequence of any one of SEQ ID NOs: 400-458. In some embodiments, the Cas9 domain and the adenosine deaminase are linked via a linker. In some embodiments, the linker comprises the amino acid sequence of any one of SEQ ID NOs: 300-318. In some embodiments, the fusion protein comprises the amino acid sequence of any one of SEQ ID NOs: 560-586. In some embodiments, the fusion protein further comprises a uracil glycosylase inhibitor (UGI) domain or a dISN domain.

One of ordinary skill in the art will recognize based on this disclosure and knowledge in the field that additional promoters operably linked to additional sgRNA sequences, or additional fusion proteins (e.g., comprising an orthogonal napDNAbp, such as an orthogonal Cas9 domain) operably linked to additional promoters, can be included in each of the writing loci for use in a eukaryotic system (e.g., a eukaryotic cell) described above, and thus the disclosure in not limited in that regard. In some embodiments, the eukaryotic system is a mammalian system (e.g., a mammalian cell). In some embodiments, the mammalian system is a human system (e.g., a human cell).

Recording Plasmids and Recording Loci

A writing plasmid described above may be used in combination with one or more recording plasmids provided herein. In general, the recording plasmid provides a target sequence that is complementary to the sgRNA that is associated with the napDNAbp provided by the writing plasmid. Changes in the target sequence induced by the expressed napDNAbp and sgRNA pair (e.g., double-strand breaks, nucleobase editing) can be monitored (i.e., "recorded"), for example, by sequencing the target sequence within the recording plasmid. In addition, a target sequence that correlates changes in DNA to a measurable quantity, such as, for example, the amount of fluorescence in a cell, can be chosen (e.g., a target sequence in a gene encoding a fluorescent protein). Alternatively, a target sequence can be a sequence in the genome of a cell (i.e., a recording locus), and changes in the target sequence induced by the expressed napDNAbp and sgRNA pair (e.g., double-strand breaks, nucleobase editing) can be monitored (i.e., "recorded"), for example, by sequencing the target sequence within the recording locus.

Some aspects of the present disclosure provide recording plasmids comprising one or more target sequences that are complementary to an sgRNA expressed in a cell. In some embodiments, the sgRNA is encoded by any of the writing plasmids described herein. In some embodiments, the recording plasmid is a recording plasmid listed in Table 3. In some embodiments, the sgRNA is encoded by a plasmid separate from the writing plasmid (e.g., an accessory plasmid). Without wishing to be bound by any particular theory, recording plasmids allow for stable, reproducible, and robust recording of a stimulus or stimuli of interest. For example, the writing plasmids used herein can sensitively detect and record the presence of one or more endogenous or exogenous stimuli, as well as provide information regarding the duration of the exposure to the stimulus (stimuli). In some aspects, the recording plasmids described herein are designed for use with a writing plasmid described herein in a prokaryotic system, where the recording plasmids are engineered high-copy number plasmids that enable analog recording of a stimulus or stimuli in a cell without requiring a large sample cell population. In addition, the recording plasmids do not impose a high fitness cost on the host system (e.g., bacterial cell, e.g., *E. coli* cell), allowing for the stable maintenance of recording plasmid levels, including a stable ratio of two recording plasmids, in the host system (e.g., bacterial cell, e.g., *E. coli* cell).

In some embodiments, the recording plasmid comprises one target sequence. In some embodiments, the recording plasmid comprises two, three, four, or five target sequences. In some embodiments, the target sequence is complementary to a sgRNA sequence provided herein, for example, a sgRNA sequence comprising a nucleic acid sequence shown in Table 5.

In some embodiments, the target sequence is present in a reporter gene. In some embodiments, the reporter gene is an EFGP gene. In some embodiments, the EGFP gene comprises the nucleic acid sequence of the wild-type EGFP gene. In some embodiments, the EGFP gene comprises the nucleic acid sequence of SEQ ID NO: M1. In some embodiments, the EGFP gene comprises the nucleic acid sequence of a modified EGFP gene. In some embodiments, the EGFP gene comprises a premature stop codon (TGA) relative to the nucleic acid sequence of the wild-type EGFP gene. In some embodiments, the EGFP gene comprises a premature stop codon (TGA) at codon 151 (EGFP-TGA151). In some embodiments, the EGFP gene comprises the nucleic acid sequence of SEQ ID NO: M2. In some embodiments, the EGFP gene comprises one or more insertions, deletions, or mutations relative to the nucleic acid sequence of the wild-type EGFP gene. In some embodiments, the EGFP gene comprises an insertion comprising 1, 2, 3, 4, 5, 6, 7, 8, 9, 10, 11, 12, 13, 14, 15, 16, 17, 18, 19, 20, 21, 22, 23, 24, 25, or more nucleic acids. In some embodiments, the EGFP gene comprises an insertion between codon 115 and codon 135 (EGFP-115-135 insertion) relative to the nucleic acid sequence of the wild-type EGFP gene. In some embodiments, the EGFP gene comprises a T206G mutation relative to the nucleic acid sequence of the wild-type EGFP gene. In some embodiments, the EGFP gene comprises an insertion between codon 115 and codon 135 (EGFP-115-135 insertion) and a T206G mutation (EGFP-115-135 insertion, T206G) relative to the nucleic acid sequence of the wild-type EGFP gene. In some embodiments, the EGFP gene comprises the nucleic acid sequence of SEQ ID NO: M3. In some embodiments, the target sequence comprises the nucleic acid sequence of SEQ ID NO: 620. In some embodiments, the target sequence comprises the nucleic acid sequence of SEQ ID NO: 621. In some embodiments, the target sequence comprises the nucleic acid sequence of SEQ ID NO: 622. In some embodiments, the target sequence comprises the nucleic acid sequence of SEQ ID NO: 623. In some embodiments, the target sequence comprises the nucleic acid sequence of SEQ ID NO: 624. In some embodiments, the target sequence comprises the nucleic acid sequence of SEQ ID NO: 625. In some embodiments, the target sequence comprises the nucleic acid sequence of SEQ ID NO: 626.

In some embodiments, the target sequence is present in a reporter gene comprising a nucleic acid sequence that encodes a protein. In some embodiments, the protein is a reporter protein. For example, the reporter gene can encode a reporter protein that is detectable and quantifiable. In some embodiments, the reporter protein induces visually identifiable characteristics which includes, without limitation fluorescent and luminescent proteins. Examples include the gene that encodes jellyfish green fluorescent protein (GFP), which causes cells that express it to glow green under blue light, the enzyme luciferase, which catalyzes a reaction with luciferin to produce light, and the red fluorescent protein from the gene dsRed. In some embodiments, the reporter protein is a fluorescent protein. In some embodiments, the reporter protein is a green fluorescent protein (GFP). In some embodiments, the reporter protein is an enhanced green fluorescent protein (EGFP). In some embodiments, the reporter is a reporter that can be used in bacteria. A common reporter in bacteria is the *E. coli* lacZ gene, which encodes the protein beta-galactosidase. This enzyme causes bacteria expressing the gene to appear blue when grown on a medium that contains the substrate analog X-gal. An example of a selectable-marker which is also a reporter in bacteria is the chloramphenicol acetyltransferase (CAT) gene, which confers resistance to the antibiotic chloramphenicol.

In some embodiments, the target sequence is present in a reporter gene comprising a nucleic acid sequence that encodes a full-length EFGP protein. In some embodiments, the full-length EFGP protein comprises the amino acid sequence of SEQ ID NO: 660. In some embodiments, the reporter gene comprises a nucleic acid sequence that encodes a EFGP protein variant. In some embodiments, the EGFP variant comprises the amino acid sequence of SEQ ID NO: 662. In some embodiments, the reporter gene comprises a nucleic acid sequence that encodes a truncated EFGP protein. In some embodiments, the truncated EFGP protein comprises the amino acid sequence of SEQ ID NO: 661. The truncated EGFP protein may be any EGFP protein that cannot fluoresce (i.e., a non-functional reporter protein).

```
EGFP (wild-type, full-length):
                                      (SEQ ID NO: 660)
MVSKGEELFTGVVPILVELDGDVNGHKFSVSGEGEGDATYGKLTLKFICT

TGKLPVPWPTLVTTLTYGVQCFSRYPDHMKQHDFFKSAMPEGYVQERTIF

FKDDGNYKTRAEVKFEGDTLVNRIELKGIDFKEDGNILGHKLEYNYNSHN

VYIMADKQKNGIKVNFKIRHNIEDGSVQLADHYQQNTPIGDGPVLLPDNH

YLSTQSALSKDPNEKRDHMVLLEFVTAAGITLGMDELYK

EGFP-151TGA:
                                      (SEQ ID NO: 661)
MVSKGEELFTGVVPILVELDGDVNGHKFSVSGEGEGDATYGKLTLKFICT

*GKLPVPWPTLVTTLTYGVQCFSRYPDHMKQHDFFKSAMPEGYVQERTIF

FKDDGNYKTRAEVKFEGDTLVNRIELKGIDFKEDGNILGHKLEYNYNSHN

VYIMADKQKNGIKVNFKIRHNIEDGSVQLADHYQQNTPIGDGPVLLPDNH

YLSTQSALSKDPNEKRDHMVLLEFVTAAGITLGMDELYK

EGFP-115-135insertion/T206G:
                                      (SEQ ID NO: 662)
MVSKGEELFTGVVPILVELDGDVNGHKFSVSGEGEGDALKTTLTYTYGKL

TLKFICTTGKLPVPWPTLGTTLTYGVQCFSRYPDHMKQHDFFKSAMPEGY

VQERTIFFKDDGNYKTRAEVKFEGDTLVNRIELKGIDFKEDGNILGHKLE

YNYNSHNVYIMADKQKNGIKVNFKIRHNIEDGSVQLADHYQQNTPIGDGP

VLLPDNHYLSTQSALSKDPNEKRDHMVLLEFVTAAGITLGMDELYK
```

In some embodiments, variants or homologues of EGFP (e.g., variants of SEQ ID NO: 660) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 660. In some embodiments, variants of EGFP (e.g., variants of SEQ ID NO: 660) are provided having amino acid sequences which are shorter, or longer than SEQ ID NO: 660, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more.

In some embodiments, the recording plasmid further comprises one or more nucleic acid sequences encoding one or more antibiotic resistant proteins, or variants thereof. Without wishing to be bound by any particular theory, the inclusion of one or more antibiotic resistance proteins in the recording plasmid system provides a mechanism for "resetting" or "erasing" a cell data recorder system that comprises the recording plasmid (see Example 3). In some embodiments, the recording plasmid comprises one nucleic acid sequence encoding an antibiotic resistant protein, or variant thereof. In some embodiments, the antibiotic resistance protein comprises one or more mutations in the amino acid sequence of the wild-type antibiotic resistance protein.

In some embodiments, the antibiotic resistance protein is chloramphenicol acetyltransferase (Cat). When expressed, the Cat protein confers chloramphenicol resistance to the host system (e.g. *E. coli* cell). In some embodiments, the Cat protein comprises the amino acid sequence of SEQ ID NO: P1. In some embodiments, the Cat protein comprises one or more mutations in the amino acid sequence of the wild-type antibiotic protein (e.g., SEQ ID NO: P1). In some embodiments, the antibiotic resistance protein is a Cat variant (e.g., the Cat variant comprises one or more inactivating mutations). In some embodiments, the Cat variant does not confer chloramphenicol resistance. In some embodiments, the Cat variant comprises a H195A mutation in the amino acid sequence provided by SEQ ID NO: P1.

In some embodiments, the antibiotic resistance protein is aminoglycoside-3'-phosphotransferase (Aph3'). When expressed, the Aph3' protein confers kanamycin resistance to the host system (e.g. E. coli cell). In some embodiments, the Aph3' protein comprises the amino acid sequence of SEQ ID NO: P2. In some embodiments, the Aph3' protein comprises one or more mutations in the amino acid sequence of the wild-type antibiotic protein (e.g., SEQ ID NO: P2). In some embodiments, the antibiotic resistance protein is a Aph3' variant (e.g., the Aph3' variant comprises one or more inactivating mutations). In some embodiments, the Aph3' variant does not confer kanamycin resistance. In some embodiments, the Aph3' variant comprises a D208A mutation in the amino acid sequence provided by SEQ ID NO: P2.

In some embodiments, the recording plasmid comprises two nucleic acid sequences, wherein each sequence encodes an antibiotic resistant protein, or variant thereof. In some embodiments, one of the antibiotic resistance proteins comprises one or more mutations in the amino acid sequence of the wild-type antibiotic protein. In some embodiments, the recording plasmid comprises a nucleic acid sequence encoding a Cat protein, or variant thereof, and a nucleic acid sequence encoding a Aph3' protein, or variant thereof. In some embodiments, the Cat protein comprises the amino acid sequence of SEQ ID NO: P1. In some embodiments, the Cat variant comprises a H195A mutation in the amino acid sequence provided by SEQ ID NO: P1. In some embodiments, the Aph3' protein comprises the amino acid sequence of SEQ ID NO: P2. In some embodiments, the Aph3' variant comprises a D208A mutation in the amino acid sequence provided by SEQ ID NO: P2. In some embodiments, the recording plasmid comprises a nucleic acid sequence encoding a Cat protein, or variant thereof, and a nucleic acid sequence encoding a Aph3' protein, or variant thereof. In some embodiments, the recording plasmid comprises (a) a nucleic acid sequence encoding a Cat variant comprising a H195A mutation in the amino acid sequence provided by SEQ ID NO: P1, wherein the H195A mutation results in a Cat protein that does not confer chloramphenicol resistance, and (b) a nucleic acid sequence encoding aminoglycoside-3'-phosphotransferase (Aph3'), wherein the Aph3' protein confers kanamycin resistance. In some embodiments, the recording plasmid comprises the nucleic acid sequence of SEQ ID NO: 667. In some embodiments, the recording plasmid encodes a protein comprising the amino acid sequence of SEQ ID NO: 668. In some embodiments, the recording plasmid comprises (a) a nucleic acid sequence encoding chloramphenicol acetyltransferase (Cat), and wherein the Cat protein confers chloramphenicol resistance, and (b) a nucleic acid sequence encoding a Aph3' protein comprising a D208A mutation in the amino acid sequence provided by SEQ ID NO: P2, and wherein the D208A mutation results in a Aph3' protein that does not confer kanamycin resistance. In some embodiments, the recording plasmid comprises the nucleic acid sequence of SEQ ID NO: 669. In some embodiments, the recording plasmid encodes a protein comprising the amino acid sequence of SEQ ID NO: 670.

```
Cat*- Aph3' (*denotes H195A active site mutation) nucleic acid
sequence
                                                         (SEQ ID NO: 667)
ATGGAGAAAAAAATCACTGGATATACCACCGTTGATATATCCCAATGGCATCGTAAAGAACATTTTGAGGCAT

TTCAGTCAGTTGCTCAATGTACCTATAACCAGACCGTTCAGCTGGATATTACGGCCTTTTTAAAGACCGTAAA

GAAAAATAAGCACAAGTTTTATCCGGCCTTTATTCACATTCTTGCCCGCCTGATGAATGCTCATCCGGAGTTC

CGTATGGCAATGAAAGACGGTGAGCTGGTGATATGGGATAGTGTTCACCCTTGTTACACCGTTTTCCATGAGC

AAACTGAAACGTTTTCATCGCTCTGGAGTGAATACCACGACGATTTCCGGCAGTTTCTACACATATATTCGCA

AGATGTGGCGTGTTACGGTGAAAACCTGGCCTATTTCCCTAAAGGGTTTATTGAGAATATGTTTTTCGTCTCA

GCCAATCCCTGGGTGAGTTTCACCAGTTTTGATTTAAACGTGGCCAATATGGACAACTTCTTCGCCCCCGTTT

TCACTATGGGCAAATATTATACGCAAGGCGACAAGGTGCTGATGCCGCTGGCGATTCAGGTTCATGCTGCCGT

TTGTGATGGCTTCCATGTCGGCAGAATGCTTAATGAATTACAACAGTACTGCGATGAGTGGCAGGGCGGGCG

GGCAGCGGTTCTGGCTCCAGCCATATTCAACGGGAAACGTCTTGCTCGAGGCCGCGATTAAATTCCAACATGG

ATGCTGATTTATATGGGTATAAATGGGCTCGCGATAATGTCGGGCAATCAGGTGCGACAATCTATCGATTGTA

TGGGAAGCCCGATGCGCCAGAGTTGTTTCTGAAACATGGCAAAGGTAGCGTTGCCAATGATGTTACAGATGAG

ATGGTCAGACTAAACTGGCTGACGGAATTTATGCCTCTTCCGACCATCAAGCATTTTATCCGTACTCCTGATG

ATGCATGGTTACTCACCACTGCGATCCCCGGGAAAACAGCATTCCAGGTATTAGAAGAATATCCTGATTCAGG

TGAAAATATTGTTGATGCGCTGGCAGTGTTCCTGCGCCGGTTGCATTCGATTCCTGTTTGTAATTGTCCTTTT

AACAGCGATCGCGTATTTCGTCTCGCTCAGGCGCAATCACGAATGAATAACGGTTTGGTTGATGCGAGTGATT

TTGATGACGAGCGTAATGGCTGGCCTGTTGAACAAGTCTGGAAAGAAATGCATAAGCTTTTGCCATTCTCACC

GGATTCAGTCGTCACTCATGGTGATTTCTCACTTGATAACCTTATTTTTGACGAGGGGAAATTAATAGGTTGT
```

-continued

```
ATTGATGTTGGACGAGTCGGAATCGCAGACCGATACCAGGATCTTGCCATCCTATGGAACTGCCTCGGTGAGT

TTTCTCCTTCATTACAGAAACGGCTTTTTCAAAAATATGGTATTGATAATCCTGATATGAATAAATTGCAGTT

TCATTTGATGCTCGATGAGTTTTTCTAA
```

Cat*- Aph3' (*denotes H195A active site mutation) amino acid sequence
(SEQ ID NO: 668)

```
MEKKITGYTTVDISQWHRKEHFEAFQSVAQCTYNQTVQLDITAFLKTVKKNKHKFYPAFIHILARLMNAHPEF

RMAMKDGELVIWDSVHPCYTVFHEQTETFSSLWSEYHDDFRQFLHIYSQDVACYGENLAYFPKGFIENMFFVS

ANPWVSFTSFDLNVANMDNFFAPVFTMGKYYTQGDKVLMPLAIQVHAAVCDGFHVGRMLNELQQYCDEWQGGA

GSGSGSSHIQRETSCSRPRLNSNMDADLYGYKWARDNVGQSGATIYRLYGKPDAPELFLKHGKGSVANDVTDE

MVRLNWLTEFMPLPTIKHFIRTPDDAWLLTTAIPGKTAFQVLEEYPDSGENIVDALAVFLRRLHSIPVCNCPF

NSDRVFRLAQAQSRMNNGLVDASDFDDERNGWPVEQVWKEMHKLLPFSPDSVVTHGDFSLDNLIFDEGKLIGC

IDVGRVGIADRYQDLAILWNCLGEFSPSLQKRLFQKYGIDNPDMNKLQFHLMLDEFF
```

Cat- Aph3'* (*denotes D208A active site mutation) nucleic acid sequence
(SEQ ID NO: 669)

```
ATGGAGAAAAAATCACTGGATATACCACCGTTGATATATCCCAATGGCATCGTAAAGAACATTTTGAGGCAT

TTCAGTCAGTTGCTCAATGTACCTATAACCAGACCGTTCAGCTGGATATTACGGCCTTTTTAAAGACCGTAAA

GAAAAATAAGCACAAGTTTTATCCGGCCTTTATTCACATTCTTGCCCGCCTGATGAATGCTCATCCGGAGTTC

CGTATGGCAATGAAAGACGGTGAGCTGGTGATATGGGATAGTGTTCACCCTTGTTACACCGTTTTCCATGAGC

AAACTGAAACGTTTTCATCGCTCTGGAGTGAATACCACGACGATTTCCGGCAGTTTCTACACATATATTCGCA

AGATGTGGCGTGTTACGGTGAAAACCTGGCCTATTTCCCTAAAGGGTTTATTGAGAATATGTTTTTCGTCTCA

GCCAATCCCTGGGTGAGTTTCACCAGTTTTGATTTAAACGTGGCCAATATGGACAACTTCTTCGCCCCCGTTT

TCACTATGGGCAAATATTATACGCAAGGCGACAAGGTGCTGATGCCGCTGGCGATTCAGGTTCATCATGCCGT

TTGTGATGGCTTCCATGTCGGCAGAATGCTTAATGAATTACAACAGTACTGCGATGAGTGGCAGGGCGGGGCG

GGCAGCGGTTCTGGCTCCAGCCATATTCAACGGGAAACGTCTTGCTCGAGGCCGCGATTAAATTCCAACATGG

ATGCTGATTTATATGGGTATAAATGGGCTCGCGATAATGTCGGGCAATCAGGTGCGACAATCTATCGATTGTA

TGGGAAGCCCGATGCGCCAGAGTTGTTTCTGAAACATGGCAAAGGTAGCGTTGCCAATGATGTTACAGATGAG

ATGGTCAGACTAAACTGGCTGACGGAATTTATGCCTCTTCCGACCATCAAGCATTTTATCCGTACTCCTGATG

ATGCATGGTTACTCACCACTGCGATCCCCGGGAAAACAGCATTCCAGGTATTAGAAGAATATCCTGATTCAGG

TGAAAATATTGTTGATGCGCTGGCAGTGTTCCTGCGCCGGTTGCATTCGATTCCTGTTTGTAATTGTCCTTTT

AACAGCGATCGCGTATTTCGTCTCGCTCAGGCGCAATCACGAATGAATAACGGTTTGGTTGATGCGAGTGATT

TTGATGACGAGCGTAATGGCTGGCCTGTTGAACAAGTCTGGAAAGAAATGCATAAGCTTTTGCCATTCTCACC

GGATTCAGTCGTCACTCATGGTGATTTCTCACTTGATAACCTTATTTTTGACGAGGGGAAATTAATAGGTTGT

ATTGCTGTTGGACGAGTCGGAATCGCAGACCGATACCAGGATCTTGCCATCCTATGGAACTGCCTCGGTGAGT

TTTCTCCTTCATTACAGAAACGGCTTTTTCAAAAATATGGTATTGATAATCCTGATATGAATAAATTGCAGTT

TCATTTGATGCTCGATGAGTTTTTCTAA
```

Cat- Aph3'* (*denotes D208A active site mutation) amino acid sequence
(SEQ ID NO: 670)

```
MEKKITGYTTVDISQWHRKEHFEAFQSVAQCTYNQTVQLDITAFLKTVKKNKHKFYPAFIHILARLMNAHPEF

RMAMKDGELVIWDSVHPCYTVFHEQTETFSSLWSEYHDDFRQFLHIYSQDVACYGENLAYFPKGFIENMFFVS

ANPWVSFTSFDLNVANMDNFFAPVFTMGKYYTQGDKVLMPLAIQVHAAVCDGFHVGRMLNELQQYCDEWQGGA

GSGSGSSHIQRETSCSRPRLNSNMDADLYGYKWARDNVGQSGATIYRLYGKPDAPELFLKHGKGSVANDVTDE

MVRLNWLTEFMPLPTIKHFIRTPDDAWLLTTAIPGKTAFQVLEEYPDSGENIVDALAVFLRRLHSIPVCNCPF

NSDRVFRLAQAQSRMNNGLVDASDFDDERNGWPVEQVWKEMHKLLPFSPDSVVTHGDFSLDNLIFDEGKLIGC

IAVGRVGIADRYQDLAILWNCLGEFSPSLQKRLFQKYGIDNPDMNKLQFHLMLDEFF
```

In some embodiments, the origin of replication (ORI) comprises a nucleic acid sequence suitable for use in a prokaryotic system. In some embodiments, the origin of replication (ORI) comprises a bacterial origin of replication sequence. In some embodiments, the origin of replication comprises a CloDF13, CloE1, pSC101, pMB1, pBR322, ColE1, pUC, RSF1030, or p15A origin of replication sequence. In some embodiments, the origin of replication comprises a pUC origin of replication sequence. In some embodiments, the origin of replication comprises a RSF1030 origin of replication sequence. In some embodiments, the origin of replication sequence comprises an origin of replication sequence shown in Table 3.

In some embodiments, the recording plasmid comprises a promoter. In some embodiments, the promoter is a constitutive promoter. In some embodiments, the constitutive promoter is a BAD promoter. In some embodiments, the promoter is selected from the promoters shown in Table 7.

In other embodiments, the target sequence is present in a recording locus. In some embodiments, the recording locus is located in a safe harbor locus. In some embodiments, the safe harbor locus is located in the CCR5 gene. In some embodiments, the CCR5 gene is a human CCR5 gene.

Cell Data Recorder Systems

Some aspects of the disclosure provide a cell data recording system for use in a prokaryotic cell comprising any of the writing plasmids described herein in combination with one or more of the recording plasmids described herein. In other aspects, the disclosure provides a cell data recording system for use in a eukaryotic system comprising any of the writing plasmids described herein designed to target a recording locus (e.g., a locus in the genome of a cell) in a eukaryotic cell. In some embodiments, the writing plasmid provides a nucleic acid programmable DNA binding protein (e.g., a Cas9 domain) or a fusion protein (e.g., a fusion protein comprising a nucleic acid programmable DNA binding protein and a nucleic acid editing domain, e.g., base editor) that induces changes in cellular DNA (e.g., double-strand breaks, nucleobase editing) when operably linked to promoters that sense the presence of one or more stimuli or cell state changes. When coupled with one or more of the recording plasmids described herein, the writing plasmid induces a measurable change (e.g., double-strand breaks, nucleobase editing) in a target sequence within one of or more of the recording plasmids in response to a stimulus or set of stimuli. In contrast to digital memory devices that store information (e.g., the presence or absence of a stimulus) in one of two distinct states (i.e., "on" or "off"), these cell data recorders induce permanent marks in cellular DNA in a manner that reflects both the strength (i.e., amplitude) and duration of one or more stimuli. In addition, the writing plasmids and recording plasmids described herein can be employed in multiple different combinations depending on the desired stimulus or set of stimuli to be measured and recorded. That is, in addition to being able to measure a single stimulus, these writing plasmids and recording plasmids provide a multiplexable system for measuring cell states. Thus, in some aspects, provided herein are analog, multi-event cell data recording systems (also referred to as a "CRISPR-mediated analog multi-event recording apparatus" or "CAMERA") that have the ability to simultaneously record multiple cell states, including, for example, exposure to stimuli such as antibiotics, nutrients, viruses, light, and cellular signaling cascades. Importantly, these cell data recorders employ modern high-throughput sequencing technologies to measure readout (e.g., changes in cellular DNA) and are not dependent on large cell populations for both recording of stimuli or readout of the changes in cellular DNA induced by these stimuli.

In one aspect, provided herein is a cell data recorder system for use in a prokaryotic cell comprising: (a) a writing plasmid suitable for use in a prokaryotic cell described herein; (b) a first recording plasmid selected from the recording plasmids provided herein; and (c) a second recording plasmid selected from the recording plasmids provided herein. In some embodiments, the first recording plasmid and the second recording plasmid are not the same. In some embodiments, the cell data recorder system is selected from those shown in Table 2.

In some embodiments, the writing plasmid comprises: (i) a nucleic acid sequence encoding a nucleic acid programmable DNA binding protein (napDNAbp) operably linked to a promoter; and (ii) an origin of replication. In some embodiments, the writing plasmid comprises: (i) a nucleic acid sequence encoding (a) a nucleic acid programmable DNA binding protein (napDNAbp) and (b) a single guide RNA (sgRNA), wherein the nucleic acid sequence of (i) is operably linked to a promoter; and (ii) an origin of replication. In some embodiments, the writing plasmid comprises: (i) a nucleic acid sequence encoding a nucleic acid programmable DNA binding protein (napDNAbp) operably linked to a first promoter; (ii) a nucleic acid sequence encoding a single guide RNA (sgRNA) operably linked to a second promoter; and (iii) an origin of replication. In some embodiments, the writing plasmid comprises: (i) a nucleic acid sequence encoding a nucleic acid programmable DNA binding protein (napDNAbp) operably linked to a first promoter; (ii) a nucleic acid sequence encoding a first single guide RNA (sgRNA) operably linked to a second promoter; (iii) a nucleic acid sequence encoding a second single guide RNA (sgRNA) operably linked to a third promoter; and (iii) an origin of replication.

In some embodiments, the cell data recorder system comprises: (a) a writing plasmid comprising: (i) a nucleic acid sequence encoding a napDNAbp operably linked to an inducible promoter, (ii) a nucleic acid sequence encoding a sgRNA operably linked to a constitutive promoter, wherein the sgRNA is complementary to a target sequence, and (iii) an origin of replication; (b) a first recording plasmid comprising a target sequence; and (c) a second recording plasmid comprising a reporter gene comprising a nucleic acid sequence that encodes a reporter protein, such as an EFGP variant. In some embodiments, the sgRNA is constitutively expressed. In some embodiments, the sgRNA associates with the napDNAbp under conditions (e.g., a stimulus) that induce the expression of the napDNAbp. In some embodiments, the inducible promoter is an anhydrotetracycline-inducible promoter. In some embodiments, the constitutive promoter is a constitutive Lac promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 660. In some embodiments, the EGFP variant comprises the amino acid sequence of SEQ ID NO: 661.

In some embodiments, the cell data recorder system comprises: (a) a writing plasmid comprising: (i) a nucleic acid sequence encoding a napDNAbp operably linked to a first inducible promoter, (ii) a nucleic acid sequence encoding a sgRNA operably linked to a second inducible promoter, wherein the sgRNA is complementary to a target sequence, and (iii) an origin of replication; (b) a first recording plasmid comprising a target sequence; and (c) a second recording plasmid comprising a reporter gene comprising a nucleic acid sequence that encodes an EFGP variant. In some embodiments, the sgRNA associates with the napDNAbp under conditions (e.g., a stimulus) that induce the expression of the sgRNA and the expression of the napDNAbp. In some embodiments, the first inducible promoter is an anhydrotetracycline-inducible promoter. In some embodiments, the second inducible promoter is an IPTG-promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 600. In some embodiments, the EGFP variant comprises the amino acid sequence of SEQ ID NO: 661.

In some embodiments, the cell data recorder system comprises: (a) a writing plasmid comprising (i) a nucleic acid sequence encoding a napDNAbp operably linked to a first inducible promoter, (ii) a nucleic acid sequence encoding a sgRNA operably linked to a second inducible promoter, wherein the sgRNA is complementary to a target sequence, and (iii) an origin of replication; (b) a first recording plasmid comprising a target sequence; and (c) a second recording plasmid comprising a reporter gene comprising a nucleic acid sequence that encodes an EFGP variant. In some embodiments, the sgRNA associates with the napDNAbp under conditions (e.g., a stimulus) that induce the expression of the sgRNA and the expression of the napDNAbp. In some embodiments, the first inducible promoter is an anhydrotetracycline-inducible promoter. In some embodiments, the second inducible promoter is an IPTG-promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 600. In some embodiments, the EGFP variant comprises the amino acid sequence of SEQ ID NO: 661. In some embodiments, the first recording plasmid further comprises (i) a nucleic acid sequence encoding a Cat variant comprising a H195A mutation in the amino acid sequence provided by SEQ ID NO: P1, wherein the H195A mutation results in a Cat protein that does not confer chloramphenicol resistance, and (ii) a nucleic acid sequence encoding aminoglycoside-3'-phosphotransferase (Aph3'), wherein the Aph3' protein confers kanamycin resistance. In some embodiments, the first recording plasmid comprises the nucleic acid sequence of SEQ ID NO: 667. In some embodiments, the second recording plasmid further comprises (i) a nucleic acid sequence encoding chloramphenicol acetyltransferase (Cat), and wherein the Cat protein confers chloramphenicol resistance, and (ii) a nucleic acid sequence encoding a Aph3' protein comprising a D208A mutation in the amino acid sequence provided by SEQ ID NO: P2, and wherein the D208A mutation results in a Aph3' protein that does not confer kanamycin resistance. In some embodiments, the second recording plasmid comprises the nucleic acid sequence of SEQ ID NO: 669.

In some embodiments, the cell data recorder system comprises: (a) a writing plasmid comprising (i) a nucleic acid sequence encoding a napDNAbp operably linked to a first inducible promoter, (ii) a nucleic acid sequence encoding a first sgRNA operably linked to a second inducible promoter, wherein the first sgRNA is complementary to a target sequence, (iii) a nucleic acid sequence encoding a second sgRNA operably linked to a third inducible promoter, wherein the second sgRNA is complementary to a target sequence, and (iv) an origin of replication; (b) a first recording plasmid comprising a target sequence complementary to the first sgRNA; and (c) a second recording plasmid comprising target sequence complementary to the second sgRNA. In some embodiments, the first sgRNA associates with the napDNAbp only under conditions (e.g., a stimulus or set of stimuli) that induce the expression of the first sgRNA and expression of the napDNAbp. In some embodiments, the second sgRNA associates with the napDNAbp only under conditions (e.g., a stimulus or set of stimuli) that induce the expression of the second sgRNA and expression of the napDNAbp. In some embodiments, the first inducible promoter is an anhydrotetracycline-inducible promoter. In some embodiments, the second inducible promoter is an IPTG-inducible promoter. In some embodiments, the third inducible promoter is a rhamnose-inducible promoter. In some embodiments, the target sequence complementary to the first sgRNA is present in a reporter gene comprising a nucleic acid sequence that encodes a full-length EFGP protein. In some embodiments, the full-length EFGP protein comprises the amino acid sequence of SEQ ID NO: 660. In some embodiments, the target sequence complementary to the first sgRNA is present in a reporter gene comprising a nucleic acid sequence that encodes an EFGP variant. In some embodiments, the EGFP variant comprises the amino acid sequence of SEQ ID NO: 661. In some embodiments, the first recording plasmid further comprises (i) a nucleic acid sequence encoding a Cat variant comprising a H195A mutation in the amino acid sequence provided by SEQ ID NO: PI, wherein the H195A mutation results in a Cat protein that does not confer chloramphenicol resistance, and (ii) a nucleic acid sequence encoding aminoglycoside-3'-phosphotransferase (Aph3'), wherein the Aph3' protein confers kanamycin resistance. In some embodiments, the first recording plasmid comprises the nucleic acid sequence of SEQ ID NO: 667. In some embodiments, the second recording plasmid further comprises (i) a nucleic acid sequence encoding chloramphenicol acetyltransferase (Cat), and wherein the Cat protein confers chloramphenicol resistance, and (ii) a nucleic acid sequence encoding a Aph3' protein comprising a D208A mutation in the amino acid sequence provided by SEQ ID NO: P2, and wherein the D208A mutation results in a Aph3' protein that does not confer kanamycin resistance. In some embodiments, the second recording plasmid comprises the nucleic acid sequence of SEQ ID NO: 669.

In another aspect, provided herein is a cell data recorder system for use in a prokaryotic cell comprising: (a) a writing plasmid suitable for use in a prokaryotic cell described herein; and (b) one or more recording plasmid selected from the recording plasmids provided herein. In some embodiments, the cell data recorder system comprises one recording plasmid. In some embodiments, the cell data recorder system is selected from those shown in Table 2.

In some embodiments, the writing plasmid comprises: (i) a nucleic acid sequence encoding a fusion protein comprising a nucleic acid programmable DNA binding protein (napDNAbp) and a nucleic acid editing domain operably linked to a promoter; and (ii) an origin of replication. In some embodiments, the writing plasmid comprises: (i) a nucleic acid sequence encoding (a) a fusion protein comprising a nucleic acid programmable DNA binding protein (napDNAbp) and a nucleic acid editing domain and (b) a single guide RNA (sgRNA), wherein the nucleic acid sequence of (i) is operably linked to a promoter; and (ii) an origin of replication. In some embodiments, the writing plasmid comprises: (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a single guide RNA (sgRNA) operably linked to a second promoter; and (iii) an origin of replication. In some embodiments, the writing plasmid comprises: (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a first single guide RNA (sgRNA) operably linked to a second promoter; (iii) a nucleic acid sequence encoding a second single guide RNA (sgRNA) operably linked to a third promoter; and (iv) an origin of replication. In some embodiments, the writing plasmid comprises: (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a first single guide RNA (sgRNA) operably linked to a second promoter; (iii) a nucleic acid sequence encoding a second single guide RNA (sgRNA) operably linked to a third promoter; (iv) a nucleic acid sequence encoding a third single guide RNA (sgRNA) operably linked to a fourth promoter; and (iv) an origin of replication.

In some embodiments, the cell data recorder system comprises: (a) a writing plasmid comprising (i) a nucleic acid sequence encoding a fusion protein comprising a napDNAbp and a nucleic acid editing domain operably linked to an inducible promoter, (ii) a nucleic acid sequence encoding a sgRNA operably linked to a constitutive promoter, wherein the sgRNA is complementary to a target sequence, and (iii) an origin of replication; and (b) a recording plasmid comprising a target sequence. In some embodiments, the sgRNA is constitutively expressed. In some embodiments, the sgRNA associates with the napDNAbp under conditions (e.g., a stimulus) that induce the expression of the fusion protein. In some embodiments, the inducible promoter is an anhydrotetracycline-inducible promoter. In some embodiments, the constitutive promoter is a constitutive Lac promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 660.

In some embodiments, the cell data recorder system comprises: (a) a writing plasmid comprising (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication; and (b) a recording plasmid comprising a target sequence. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is an IPTG-inducible promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 660.

In some embodiments, the cell data recorder system comprises: (a) a writing plasmid comprising (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication; and (b) a recording plasmid comprising a target sequence. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is an arabinose-inducible promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 660.

In some embodiments, the cell data recorder system comprises: (a) a writing plasmid comprising (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication; and (b) a recording plasmid comprising a target sequence. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is a rhamnose-inducible promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 660.

In some embodiments, the cell data recorder system comprises: (a) a writing plasmid comprising (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication; and (b) a recording plasmid comprising a target sequence. In some embodiments, the sgRNA associates with the napDNAbp only under conditions (e.g., a stimulus or set of stimuli) that induce the expression of the fusion protein and expression of the sgRNA. In some embodiments, the first inducible promoter is an anhydrotetracycline-inducible promoter. In some embodiments, the second inducible promoter is a phage shock promoter (PSP). In some embodiments, expression of the sgRBA is induced by the presence of a phage. In some embodiments, the target sequence is present in a reporter gene comprising a nucleic acid sequence that encodes a full-length EFGP protein. In some embodiments, the full-length EFGP protein comprises the amino acid sequence of SEQ ID NO: 660.

In some embodiments, the cell data recorder system comprises: (a) a writing plasmid comprising (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication; and (b) a recording plasmid comprising a target sequence. In some embodiments, the sgRNA associates with the napDNAbp only under conditions (e.g., a stimulus or set of stimuli) that induce the expression of the fusion protein and expression of the sgRNA. In some embodiments, the first inducible promoter is a light-inducible promoter. In some embodiments, expression of the fusion protein is induced in the presence of light, wherein the light inhibits the binding of a repressor to the first inducible promoter. In some embodiments, the second inducible promoter is an IPTG-inducible promoter. In some embodiments, the target sequence is present in a reporter gene comprising a nucleic acid sequence that encodes a full-length EFGP protein. In some embodiments, the full-length EFGP protein comprises the amino acid sequence of SEQ ID NO: 660.

In some embodiments, the cell data recorder system comprises: (a) a writing plasmid comprising (i) a nucleic acid sequence encoding a fusion protein comprising a napDNAbp and a nucleic acid editing domain operably linked to a first inducible promoter, (ii) a nucleic acid sequence encoding a first sgRNA operably linked to a second inducible promoter, wherein the first sgRNA is complementary to a first target sequence, (iii) a nucleic acid sequence encoding a second sgRNA operably linked to a third inducible promoter, wherein the second sgRNA is complementary to a second target sequence, and (iv) an origin of replication; and (b) a recording plasmid comprising a target sequence. In some embodiments, the first sgRNA associates with the napDNAbp only under conditions (e.g., a stimulus or set of stimuli) that induce the expression of the fusion protein and the expression of the first sgRNA. In some embodiments, the second sgRNA associates with the napDNAbp only under conditions (e.g., a stimulus or set of stimuli) that induce the expression of the fusion protein and the expression of the second sgRNA. In some embodiments, the first inducible promoter is an anhydrotetracycline-inducible promoter. In some embodiments, the second inducible promoter is an arabinose-inducible promoter. In some embodiments, the third inducible promoter is a rhamnose-inducible promoter. In some embodiments, the first sgRNA and the second sgRNA are complementary to different target sequences. In some embodiments, the second target sequence is generated by a change in the first target sequence. In some embodiments, the change in the first target sequence is induced by the fusion protein under conditions (e.g., a stimulus or set of stimuli) that induce the expression of the fusion protein and the first sgRNA. In some embodiments, the first target sequence is present in a nucleic acid sequence comprising an EGFP gene with one or more insertions, deletions, or mutations relative to the nucleic acid sequence of the wild-type EGFP gene. In some embodiments, the EGFP gene comprises an insertion between codon 115 and codon 135 (EGFP-115-135 insertion) and a T206G mutation (EGFP-115-135 insertion, T206G) relative to the nucleic acid sequence of the wild-type EGFP gene. In some embodiments, the EGFP gene comprises the nucleic acid sequence of SEQ ID NO: 652. In some embodiments, the EGFP gene encodes an EGFP protein comprising the amino acid sequence of SEQ ID NO: 662.

In some embodiments, the cell data recorder system comprises: (a) a writing plasmid comprising (i) a nucleic acid sequence encoding a fusion protein comprising a napDNAbp and a nucleic acid editing domain operably linked to a first inducible promoter, (ii) a nucleic acid sequence encoding a first sgRNA operably linked to a second inducible promoter, wherein the first sgRNA is complementary to a first target sequence, (iii) a nucleic acid encoding a second sgRNA operably linked to a third inducible promoter, wherein the second sgRNA is complementary to a second target sequence, (iv) a nucleic acid molecule encoding a third sgRNA operably linked to a fourth inducible promoter, wherein the third sgRNA is complementary to a third target sequence, and (v) an origin of replication; and (b) a recording plasmid comprising a target sequence. In some embodiments, the first sgRNA associates with the napDNAbp only under conditions (e.g., a stimulus or set of stimuli) that induce the expression of the fusion protein and the first sgRNA. In some embodiments, the second sgRNA associates with the napDNAbp only under conditions (e.g., a stimulus or set of stimuli) that induce the expression of the fusion protein and the second sgRNA. In some embodiments, the third sgRNA associates with the napDNAbp only under conditions (e.g., a stimulus or set of stimuli) that the expression of the fusion protein and the third sgRNA. In some embodiments, the first inducible promoter is an anhydrotetracycline-inducible promoter. In some embodiments, the second inducible promoter is an IPTG-inducible promoter. In some embodiments, the third inducible promoter is an arabinose-inducible promoter. In some embodiments, and the fourth inducible promoter is a rhamnose-inducible promoter. In some embodiments, the first target sequence, the second target sequence, and/or the third target sequence is present in a reporter gene comprising a nucleic acid sequence that encodes a full-length EFGP protein. In some embodiments, the first target sequence, the second target sequence, and the third target sequence are not the same target sequence. In some embodiments, the full-length EFGP protein comprises the amino acid sequence of SEQ ID NO: 600.

In yet another aspect, provided herein is a cell data recorder system for use in a eukaryotic cell comprising: (a) a writing plasmid suitable for use in a eukaryotic cell described herein; and (b) one or more recording loci comprising a target sequence. In some embodiments, the target sequence is complementary to an sgRNA expressed in the cell. In some embodiments, the one or more of the recording loci are located in a safe harbor locus. In some embodiments, the safe harbor locus is located in the CCR5 gene. In some embodiments, the CCR5 gene is a human CCR5 gene. In some embodiments, the cell data recorder system is selected from those shown in Table 2.

In some embodiments, the writing plasmid comprises: (i) a nucleic acid sequence encoding a fusion protein comprising a nucleic acid programmable DNA binding protein (napDNAbp) and a nucleic acid editing domain operably linked to a promoter; and (ii) an origin of replication. In some embodiments, the writing plasmid comprises: (i) a nucleic acid sequence encoding (a) a fusion protein comprising a nucleic acid programmable DNA binding protein (napDNAbp) and a nucleic acid editing domain and (b) a single guide RNA (sgRNA), wherein the nucleic acid sequence of (i) is operably linked to a promoter; and (ii) an origin of replication. In some embodiments, the writing plasmid comprises: (i) a nucleic acid sequence encoding a fusion protein comprising a nucleic acid programmable DNA binding protein (napDNAbp) and a nucleic acid editing domain operably linked to a first promoter; (ii) a nucleic acid sequence encoding a single guide RNA (sgRNA) operably linked to a second promoter; and (iii) an origin of replication.

In some embodiments, the cell data recorder system comprises: (a) a writing plasmid comprising (i) a nucleic acid sequence encoding a fusion protein comprising a napDNAbp and a nucleic acid editing domain operably linked to a first constitutive promoter, and (ii) an origin of replication; and (b) one or more recording loci comprising a target sequence. In some embodiments, the cell data recorder system further comprises: (c) a second plasmid comprising a nucleic acid encoding a first sgRNA operably liked to a second constitutive promoter, wherein the first sgRNA is complementary to a first target sequence In some embodiments, the cell data recorder system further comprises: (d) a third plasmid comprising a nucleic acid encoding a second sgRNA operably liked to a third constitutive promoter, wherein the second sgRNA is complementary to a second target sequence. In some embodiments, the cell data recorder system further comprises: (e) a fourth plasmid comprising a nucleic acid encoding a third sgRNA operably liked to a fourth constitutive promoter, wherein the third sgRNA is complementary to a third target sequence. In some embodiments, the fusion protein is constitutively expressed. In some embodiments, the fusion protein and the first sgRNA are constitutively expressed, and the first sgRNA associates with the napDNAbp. In some embodiments, the fusion protein and the second sgRNA are constitutively expressed, and the second sgRNA associates with the napDNAbp. In some embodiments, the fusion protein and the third sgRNA are constitutively expressed, and the third sgRNA associates with the napDNAbp. In some embodiments, the first, second, and third sgRNAs are not identical. In some embodiments, the first, second, and third sgRNAs are each independently complementary to a different target sequence. In some embodiments, any one of the first, second, third, and/or fourth constitutive promoter is selected from the constitutive promoters listed in Table 8. In some embodiments, the first constitutive promoter is a CMV promoter. In some embodiments, the second, third, and/or fourth constitutive promoters are different. In some embodiments, the second, third, and/or fourth constitutive promoters are the same. In some embodiments, the second, third, and/or fourth constitutive promoter comprises a U6 promoter sequence. In some embodiments, any one of the first, second, third, and/or fourth promoters can be an inducible promoter. In some embodiments, the inducible promoter is selected from a inducible promoter listed in Table 8 or Table 10. In some embodiments, the one or more of the recording loci are located in a safe harbor locus. In some embodiments, the safe harbor locus is located in the CCR5 gene. In some embodiments, the CCR5 gene is a human CCR5 gene.

In some embodiments, the cell data recorder system comprises: (a) a writing plasmid comprising (i) a nucleic acid sequence encoding a fusion protein comprising a napDNAbp and a nucleic acid editing domain operably linked to an inducible promoter, (ii) a nucleic acid encoding a sgRNA operably liked to a constitutive promoter, wherein the sgRNA is complementary to a target sequence, and (iii) an origin of replication; and (b) one or more recording loci comprising a target sequence. In some embodiments, the sgRNA is constitutively expressed and associates with the napDNAbp under conditions (e.g., a stimulus or set of stimuli) that induce the expression of the fusion protein. In some embodiments, the inducible promoter is a tetracycline-inducible promoter. In some embodiments, the stimulus that induces the expression of the fusion protein is doxycycline. In some embodiments, the constitutive promoter is a constitutive U6 promoter. In some embodiments, the recording locus is located in a safe harbor locus. In some embodiments, the safe harbor locus is located in the CCR5 gene. In some embodiments, the CCR5 gene is a human CCR5 gene.

In some embodiments, the cell data recorder system comprises: (a) a writing plasmid comprising (i) a nucleic acid sequence encoding a fusion protein comprising a napDNAbp and a nucleic acid editing domain operably linked to an inducible promoter, (ii) a nucleic acid encoding a sgRNA operably liked to a constitutive promoter, wherein the sgRNA is complementary to a target sequence, and (iii) an origin of replication. In some embodiments, the sgRNA is constitutively expressed and associates with the napDNAbp under conditions (e.g., a stimulus or set of stimuli) that induce the expression of the fusion protein. In some embodiments, the inducible promoter is a induced by a signaling molecule produced during the activation of an endogenous or an exogenous signaling cascade. In some embodiments, the endogenous signaling cascade is the Wnt signaling cascade. In some embodiments, the signaling molecule produced during an activated Wnt signaling cascade is beta-catenin. In some embodiments, the stimulus that induces the expression of the fusion protein is beta-catenin. In certain embodiments, the endogenous signaling cascade is, for example, an NF-κB, SMADs, STAT1, STAT2, STAT3, IRF-1, or E2F cascade. In some such embodiments, the stimulus is a cytokine or growth factor such as TNF, TGF-β, IL-6, IFNα, IFNγ, or EGF. In some embodiments, the signaling cascade is, for example, a CREB, C/EBP, SRF, NFAT, GR, MAPK/JNK, GATA, RAR, RXR, VDR, ARE, or a XRE/DRE cascade. In certain such embodiments the stimulus is a small molecule such as forskolin, LiCl, PMA, dexamethasone, ATRA, calcitriol, sulforaphane, or TCDD. In some embodiments, the signaling cascade is an HSF, ATF6, or CBF/NF-Y/YY1 cascade. In some embodiments, the constitutive promoter is a constitutive U6 promoter. In some embodiments, the nucleic acid sequence of (i) or (ii) further comprises a nucleic acid sequence encoding a second protein. In some embodiments, the nucleic acid sequence of (i) further comprises a nucleic acid sequence encoding a second protein. In some embodiments, the second protein is luciferase. In some embodiments, the nucleic acid sequence encoding the reporter protein is connected to the 3' end of the nucleic acid sequence of (i) by an intervening P2A sequence. In some embodiments, the recording locus is located in a safe harbor locus. In some embodiments, the safe harbor locus is located in the CCR5 gene. In some embodiments, the CCR5 gene is a human CCR5 gene.

In some embodiments, the cell data recorder system comprises: (a) a writing plasmid comprising: (i) a nucleic acid sequence encoding a fusion protein comprising a nucleic acid programmable DNA binding protein (napDNAbp) and a nucleic acid editing domain operably linked to a first constitutive promoter; and (ii) an origin of replication; and (b) one or more additional plasmids comprising a nucleic acid sequence encoding a sgRNA. In some embodiments, the cell data recorder system further comprises (c) a second plasmid comprising a nucleic acid sequence encoding a first sgRNA operably linked to a second constitutive promoter comprising a first repressor binding site, wherein the first sgRNA is complementary to a first target sequence; and (d) a third plasmid comprising a nucleic acid sequence encoding one or more repressor proteins operably linked to a third constitutive promoter. In some embodiments, the repressor protein and first sgRNA are constitutively expressed, and the repressor protein binds to the repressor binding site of the second constitutive promoter. In some embodiments, the nucleic acid sequence of (c) encodes one repressor protein. In some embodiments, the repressor protein is a tetracycline repressor protein (TetR) or a lactose repressor protein (LacI). In some embodiments, the nucleic acid sequence of (c) encodes a first repressor protein and a second repressor protein, wherein an intervening P2A sequence separates the nucleic acid sequences encoding the first and second repressor proteins. In some embodiments, the first repressor protein or the second repressor protein is a tetracycline repressor protein (TetR). In some embodiments, the first repressor protein or the second repressor protein is a lactose repressor protein (LacI). In some embodiments, the first repressor protein and the second repressor protein are not the same. In some embodiments, the first repressor protein is a lactose repressor protein (LacI). In some embodiments, the lactose repressor protein cannot bind to the first repressor binding site in the presence of IPTG. In some embodiments, the second repressor protein is a tetracycline repressor protein (TetR). In some embodiments, the tetracycline repressor protein cannot bind to the second repressor binding site in the presence of tetracycline, or a derivative thereof. In some embodiments, the tetracycline, or derivative thereof, is doxycycline. In some embodiments, the cell data recorder system further comprises (e) a fourth plasmid comprising a nucleic acid encoding a second sgRNA operably linked to a fourth constitutive promoter comprising a second repressor binding site, wherein the second sgRNA is complementary to a second target sequence, wherein the second repressor protein and the second sgRNA are constitutively expressed, and wherein the second repressor protein binds to the second repressor binding site of the fourth constitutive promoter. In some embodiments, the first constitutive promoter, the second constitutive promoter, and the third constitutive promoter, and/or the fourth constitutive promoter are selected from a CMV promoter, a U6 promoter, a H1 promoter, or a UBC promoter. In some embodiments, the first constitutive promoter, the second constitutive promoter, and the third constitutive promoter are selected from a constitutive promoter listed in Table 8. In some embodiments, the first constitutive promoter, the second constitutive promoter, the third constitutive promoter, and/or the fourth constitutive promoter are different constitutive promoters. In some embodiments, the first constitutive promoter is a CMV promoter. In some embodiments, the second constitutive promoter is a U6 promoter. In some embodiments, the third constitutive promoter is a UBC promoter. In some embodiments, the fourth constitutive promoter is a H1 promoter.

The description of exemplary embodiments of the cell data recorder systems above is provided for illustration purposes only and not meant to be limiting. Additional cell data recorder systems, e.g., variations of the exemplary systems described in detail above, are also embraced by this disclosure.

Kits and Cells

Also provided herein are kits comprising one or more writing plasmids and/or recording plasmids described herein. Some aspects of this disclosure provide kits comprising a writing plasmid provided herein. In some embodiments, the kit further comprises one or more recording plasmids provided herein. In some embodiments, the kit further comprises one or more additional plasmids, wherein the additional plasmids provide one or more sgRNA sequences complementary to a target sequence of interest. In some embodiments, the kit comprises a writing plasmid provided herein, wherein the writing plasmid comprises one or more nucleic acid sequences encoding a sgRNA, wherein the sgRNA sequences is complementary to a target sequence of interest. In some embodiments, the kit comprises a cell data recorder system provided herein.

Some aspects of this disclosure provide cells comprising one or more writing plasmids and/or recording plasmids described herein. In some embodiments, the cell comprises any of the writing plasmids described herein. In some embodiments, the cell comprises one, two, three, four, five, six, seven, eight, nine, or ten of any of the writing plasmids described herein. In some embodiments, the cell comprises one or more recording plasmids described herein. In some embodiments, the cell comprises one, two, three, four, five, six, seven, eight, nine, or ten of any of the recording plasmids described herein. In some embodiments, the cell comprises any of the cell data recorder systems described herein. In some embodiments, the cell has been engineered to comprise one or more writing plasmids and/or recording plasmids described herein. In some embodiments, the cell has been engineered to comprise a cell data recording system described herein. In some embodiments, the cell is a eukaryotic cell. In some embodiments, the cell is from a human, mouse, rat, hamster monkey, dog, opossum, rabbit, zebrafish, or insect. Exemplary eukaryotic cells include, without limitation, cells from any one of the following cell lines: 3T3-L1, 4T1, 9L, A172, A20, A253, A2780, A2780ADR, A2780cis, A431, A549, AB9, AHL-1, ALC, B16, B35, BCP-1, BEAS-2B, bEnd.3, BHK-21, BOSC23, BT-20, BxPC3, C2C12, C3H-10T1/2, C6, C6/36, Caco-2, Cal-27, Calu-3, CGR8, CHO, CML T1, CMT12, COR-L23, COR-L23/5010, COR-L23/CPR, COR-L23/R23, COS-7, COV-434, CT26, D17, DAOY, DH82, DU145, DuCaP, E14Tg2a, EL4, EM-2, EM-3, EMT6/ARI, EMT6/AR10.0, FM3, GL261, H1299, HaCaT, HCA2, HEK 293, HEK 293T, HeLa, Hep G2, Hepalc1c7, High Five, HL-60, HT-1080, HT-29, J558L, Jurkat, JY, K562, KBM-7, KCL-22, KG1, Ku812, KYO-1, L1210, L243, LNCaP, MA-104, Ma-Mel 1, 2, 3 . . . . 48, MA2.1, MC-38, MCF-10A, MCF-7, MDA-MB-157, MDA-MB-231, MDA-MB-361, MDA-MB-468, MDCK II, MG63, Mono-Mac-6, MOR/0.2R, MRC-5, MTD-1A, MyEnd, NALM-1, NCI-H69, NCI-H69/CPR, NCI-H69/LX10, NCI-H69/LX20, NCI-H69/LX4, Neuro-2a, Neuro2a, NIH-3T3, NK-92, NTERA-2, NW-145, OK, OPCN/OPCT cell lines, P3X63Ag8, PC-3, PC12, Peer, PNT1A, PNT2, Pt K2, Raji, RBL-1, RenCa, RIN-5F, RMA-S, S2, SaOS-2, Sf21, Sf9, SH-SY5Y, SiHa, SK-BR-3, SK-N-SH, SK-OV-3, T-47D, T2, T84, T98G, THP-1, U2OS, U373, U87, U937, VCaP, Vero, VG-1, WM39, WT-49, YAC-1, and YAR. In some embodiments, the eukaryotic cell is a mammalian cell. In some embodiments, the mammalian cell is a human cell (e.g., HEK293T). In some such embodiments, the cell is an immune cell such as a T cell. In certain embodiments, the engineered CAMERA-expressing T cell is capable of selecting and initiating one or more immuno-therapeutic pathways by sensing disease indicators. Inflammation signal cascades and tumor cells provide stimulatory molecules and/or effect systemic and/or localized changes that are detected by CAMERA-expressing T cells. In some embodiments, the cell is a prokaryotic cell. In some embodiments, the prokaryotic cell is a bacterial cell. In some embodiments, the bacterial cell is a gram positive bacterial cell. In some embodiments, the bacterial cell is a gram negative bacterial cell. In some embodiments, the bacterial cell is an *E. coli* cell (e.g., S1030 cell or S2063 cell). Bacterial cells of the present disclosure include bacterial subdivisions of Eubacteria and Archaebacteria. Eubacteria can be further subdivided into gram-positive and gram-negative Eubacteria, which depend upon a difference in cell wall structure. Also included herein are those classified based on gross morphology alone (e.g., cocci, bacilli). In some embodiments, the bacterial cells are Gram-negative cells, and in some embodiments, the bacterial cells are Gram-positive cells. Examples of bacterial cells of the present disclosure include, without limitation, cells from

*Lactobacillus* spp., *Lactococcus* spp., *Bacillus* spp., *Enterobacter* spp., *Yersinia* spp., *Escherichia* spp., *Klebsiella* spp., *Acinetobacter* spp., *Bordetella* spp., *Neisseria* spp., *Aeromonas* spp., *Franciesella* spp., *Corynebacterium* spp., *Citrobacter* spp., *Chlamydia* spp., Hemophilus spp., *Brucella* spp., *Mycobacterium* spp., *Legionella* spp., *Rhodococcus* spp., *Pseudomonas* spp., *Helicobacter* spp., *Salmonella* spp., *Vibrio* spp., *Erysipelothrix* spp., *Salmonella* spp., *Staphylococcus* spp., *Streptomyces* spp., *Bacteroides* spp., *Prevotella* spp., *Clostridium* spp., or *Bifidobacterium* spp. In some embodiments, the bacteria are non-pathogenic bacteria that are derived from a normal internal ecosystem such as bacterial flora. In some embodiments, the engineered microorganisms are non-pathogenic bacteria that are derived from a normal internal ecosystem of the gastrointestinal tract. Non-limiting examples of non-pathogenic bacteria that are part of the normal flora in the gastrointestinal tract include bacteria from the genera *Bacteroides, Clostridium, Fusobacterium, Eubacterium, Ruminococcus, Peptococcus, Peptostreptococcus, Bifidobacterium, Escherichia* and *Lactobacillus*. In some embodiments, bacterial cells of the disclosure are anaerobic bacterial cells (e.g., cells that do not require oxygen for growth). Anaerobic bacterial cells include facultative anaerobic cells such as, for example, *Escherichia coli, Shewanella oneidensis* and *Listeria monocytogenes*. Anaerobic bacterial cells also include obligate anaerobic cells such as, for example, *Bacteroides* and *Clostridium* species. In humans, for example, anaerobic bacterial cells are most commonly found in the gastrointestinal tract. In certain embodiments, said bacterial cells comprising one or more writing plasmids and/or recording plasmids described herein, i.e., expressing CAMERA, are used to monitor and/or affect bacterial flora of the gastrointestinal tract. Without wishing to be bound to any particular strategy, in some embodiments, engineered strains of bacteria expressing CAMERA are introduced into the gastrointestinal tract of a subject so as to allow permanent recording of transient exposure to chemical inputs and/or therapeutics. In some embodiments, the engineered strains of bacteria are triggered (e.g., by a disease indicator or a change in the environment of the gastrointestinal tract).

Methods

Some aspects of the present disclosure provide methods for stably and reproducibly recording the presence of one or more endogenous or exogenous stimuli in a cell. The cell data recorder systems described herein, as well as variations on the exemplary cell data recorder systems provided herein, can store information using a designed analog memory system that leaves permanent marks in DNA (e.g., DNA double strand breaks, DNA single strand breaks, recombinations, methylation, nucleobase editing) in a manner that reflects the strength and/or duration of the endogenous or exogenous stimulus (e.g., a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state). In addition, these multiplexable cell data recorder systems can be designed to record a specific set of stimuli (i.e., multiple stimuli), both independently and in an order dependent manner. These cell data recorder systems can be "reset" by erasing the cell data recorder system after recording of a stimulus or set of stimuli to restore the fidelity of the original cell data recorder system. Importantly, the cell data recorder systems function reproducibly after multiple rounds of recording and erasing, suggesting that these cell data recorder systems are durable, rewritable systems that can be employed in multiple round of recording and erasing without introducing unwanted off-target DNA damage (e.g., a high frequency of random insertions and deletions (indels)).

Thus, in some aspects, provided herein are methods for engineering a cell comprising contacting the cell with any of the cell data recorder systems provided herein. In some embodiments, the cell is a eukaryotic cell. In some embodiments, the eukaryotic cell is a mammalian cell. In some embodiments, the mammalian cell is a human cell (e.g., HEK293T), such as any of the cell lines provided herein. In some embodiments, the cell is a prokaryotic cell. In some embodiments, the prokaryotic cell is a bacterial cell. In some embodiments, the bacterial cell is an *E. coli* cell (e.g., S1030 cell or S2063 cell).

In some embodiments, the components of the cell data recorder system (e.g., vectors) are transfected into the cell. In some embodiments, the writing plasmid is transfected into the cell. In some embodiments, the writing plasmid does not comprise a nucleic acid sequence encoding a sgRNA. In some embodiments, from about 10 ng to about 500 ng of a plasmid (e.g., an accessory plasmid) comprising a nucleic acid sequence encoding one or more sgRNAs operably linked to one or more promoters is used in a transfection reaction for transfecting the cell. In some embodiments, from about 10 ng to about 60 ng of a plasmid (e.g., an accessory plasmid) comprising a nucleic acid sequence encoding one or more sgRNAs operably linked to one or more promoters is used in a transfection reaction for transfecting the cell. In some embodiments, about from 1 ng to 500 ng, e.g., about 40 ng, of a plasmid (e.g., an accessory plasmid) comprising a nucleic acid sequence encoding one or more sgRNAs operably linked to one or more promoters is used in a transfection reaction for transfecting the cell. In some embodiments, about 20 ng of a plasmid (e.g., an accessory plasmid) comprising a nucleic acid sequence encoding one or more sgRNAs operably linked to one or more promoters is used in a transfection reaction for transfecting the cell. In some embodiments, the cell expresses one or more sgRNAs, wherein each sgRNA is complementary to a target sequence. In some embodiments, the writing plasmid comprises one or more nucleic acid sequences encoding a sgRNA operably linked to a promoter, wherein the sgRNA is complementary to a sequence of interest. In some embodiments, one or more recording plasmids comprising a target sequence are transfected into the cell. In some embodiments, any of the cell data recorder systems provided herein are transfected into the cell.

In some embodiments, one or more components of the cell data recorder system (e.g., writing plasmid, one or more recording plasmids, additional accessory plasmids) are transfected into the cell via electroporation. In some embodiments, one or more components of the cell data recorder system (e.g., writing plasmid, one or more recording plasmids, additional accessory plasmids) are transfected into the cell via heat shock. In some embodiments, one or more components of the cell data recorder system (e.g., writing plasmid, one or more recording plasmids, additional accessory plasmids) are transfected into the cell via a composition comprising a cationic lipid reagent. In some embodiments, the cationic lipid is Lipofectamine® 2000. In some embodiments, the cationic lipid reagent is selected from those discussed in Patent Publication No. WO2015/035136, published Mar. 12, 2015, entitled "Delivery Systems for Functional Nucleases"; which is hereby incorporated by reference in its entirety. In some embodiments, from about 10 ng to about 1000 ng of a writing plasmid is used in a transfection reaction for transfecting the cell. In some embodiments, from about 500 ng to about 1000 ng of a writing plasmid is used in a transfection reaction for transfecting the cell. In some embodiments, from about 700 ng to about 900 ng of a writing plasmid is used in a transfection reaction for transfecting the cell. In some embodiments, about 800 ng of a writing plasmid is used in a transfection reaction for transfecting the cell. In some embodiments, from about 50 ng to about 150 ng of a writing plasmid is used in a transfection reaction for transfecting the cell. In some embodiments, about 100 ng of a writing plasmid is used in a transfection reaction for transfecting the cell. In some embodiments, from about 100 ng to about 1000 ng of a recording plasmid is used in a transfection reaction for transfecting the cell. In some embodiments, from about 400 ng to about 600 ng of a recording plasmid is used in a transfection reaction for transfecting the cell. In some embodiments, about 500 ng of a recording plasmid is used in a transfection reaction for transfecting the cell. In some embodiments, a 20:1 ratio of recording plasmid:writing plasmid is used in a transfection reaction for transfecting the cell. In some embodiments, a 10:1 ratio of recording plasmid:writing plasmid is used in a transfection reaction for transfecting the cell. In some embodiments, a 5:1 ratio of recording plasmid:writing plasmid is used in a transfection reaction for transfecting the cell. In some embodiments, a 2:1 ratio of recording plasmid:writing plasmid is used in a transfection reaction for transfecting the cell. In some embodiments, a 20:20:1 ratio of first recording plasmid:second recording plasmid:writing plasmid is used in a transfection reaction for transfecting the cell. In some embodiments, a 10:10:1 ratio of first recording plasmid:second recording plasmid:writing plasmid is used in a transfection reaction for transfecting the cell. In some embodiments, a 5:5:1 ratio of first recording plasmid:second recording plasmid:writing plasmid is used in a transfection reaction for transfecting the cell. In some embodiments, a 2:2:1 ratio of first recording plasmid:second recording plasmid:writing plasmid is used in a transfection reaction for transfecting the cell. In some embodiments, a 10:2:1 ratio of first recording plasmid:second recording plasmid:writing plasmid is used in a transfection reaction for transfecting the cell. In some embodiments, a 1:1 ratio of first recording plasmid:second recording plasmid is used in a transfection reaction for transfecting the cell. In some embodiments, a 2:1 ratio of first recording plasmid:second recording plasmid is used in a transfection reaction for transfecting the cell. In some embodiments, a 5:1 ratio of first recording plasmid:second recording plasmid is used in a transfection reaction for transfecting the cell. In some embodiments, a 10:1 ratio of first recording plasmid:second recording plasmid is used in a transfection reaction for transfecting the cell.

In another aspect, provided herein are methods for recording the presence and/or duration of a stimulus in an engineered cell, the method comprising: (i) providing an engineered cell comprising a cell data recorder system provided herein; and (ii) determining an amount of the first recording plasmid (R1) and an amount of the second recording plasmid (R2) in the engineered cell. In some embodiments, the engineered cell is produced by a method provided herein. In some embodiments, R1 comprises a first target sequence. In some embodiments, R2 comprises a second target sequence. In some embodiments, the first target sequence and the second target sequence are not the same. In some embodiments, the cell is a prokaryotic cell. In some embodiments, the prokaryotic cell is a bacterial cell. In some embodiments, the bacterial cell is an *E. coli* cell (e.g., S1030 cell or S2063 cell).

In some embodiments, the napDNAbp of the cell data recorder system is associated with a sgRNA complementary to the target sequence of R1, and the sgRNA is not complementary to the target sequence of R2. In some embodiments, the sgRNA is encoded by the writing plasmid, and the nucleic acid sequence encoding the sgRNA is operably linked to a promoter. In some embodiments, the sgRNA is expressed by the cell. In some embodiments, the sgRNA is not encoded by the writing plasmid. In some embodiments, the sgRNA is encoded by an additional plasmid (e.g., an accessory plasmid), and the nucleic acid sequence encoding the sgRNA is operably linked to a promoter. In some embodiments, the napDNAbp is a nuclease active Cas9 domain. In some embodiments, the target sequence of R1 is present in a reporter gene encoding a functional reporter protein. In some embodiments, the functional reporter protein is a fluorescent protein. In some embodiments, the fluorescent protein is EGFP. In some embodiments, the target sequence of R2 is present in a reporter gene encoding a non-functional reporter protein. In some embodiments, the non-functional reporter protein does not produce fluorescence.

In some embodiments, the amount of the first recording plasmid (R1), and/or the amount of the second recording plasmid (R2) is determined using high-throughput sequencing of the amplified target sequence of R1 and/or R2. In some embodiments, the amount of the first recording plasmid (R1) is determined using high-throughput sequencing of the amplified target sequence of R1. In some embodiments, the amount of the second recording plasmid (R2) is determined using high-throughput sequencing of the amplified target sequence of R2. In some embodiments, the amount of the first recording plasmid (R1), and/or the second recording plasmid (R2) is determined by measuring a level of fluorescence from the cell. In some embodiments, the level of fluorescence from the cell corresponds to the amount of functional reporter protein expressed in the cell. In some embodiments, the amount of R1 and/or R2 is determined when the cell is not contacted with a stimulus. In some embodiments, the amount of R1 and/or R2 is determined when the cell is contacted with one or more stimuli. In some embodiments, the amount of R1 and/or R2 is determined when the cell is contacted with a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the stimulus is a small molecule. In some embodiments, the stimulus is an antibiotic. In some embodiments, the stimulus is a sugar. In some embodiments, the stimulus is anhydrotetracycline, IPTG, rhamnose, arabinose, tanespimycin, tunicamycin, or doxycycline. In some embodiments, the amount of R1 and/or R2 is determined when the cell is contacted with two stimuli. In some embodiments, the cell is contacted with the two stimuli simultaneously. In some embodiments, the cell is contacted with the two stimuli sequentially. In some embodiments, the first stimulus induces expression of the napDNAbp encoded by the writing plasmid and the second stimulus induces expression of an sgRNA encoded by the writing plasmid and/or encoded by an additional plasmid (e.g., an accessory plasmid), and wherein both stimuli are required for sgRNA association with the napDNAbp. In some embodiments, the napDNAbp introduces a DNA double-strand break in the target sequence of the recording plasmid complementary to the sgRNA, thereby reducing the amount of the recording plasmid. In some embodiments, the napDNAbp introduces a DNA double-strand break in the target sequence of the recording plasmid complementary to the sgRNA, thereby reducing the amount of functional reporter protein expressed in the cell. In some embodiments, the two stimuli are independently a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the two stimuli are independently a small molecule. In some embodiments, the two stimuli are independently an antibiotic. In some embodiments, the two stimuli are independently a sugar. In some embodiments, the two stimuli are independently anhydrotetracycline, IPTG, rhamnose, arabinose, tanespimycin, tunicamycin, or doxycycline. In some embodiments, the cell is contacted with the one or more stimuli at least once. In some embodiments, the cell is contacted with the one or more stimuli at least two, at least three, at least four, at least five, at least six, at least seven, at least eight, at least nine, or at least ten times. In some embodiments, the cell is contacted with the one or more stimuli more than ten times. In some embodiments, in the presence of one or more stimuli, the napDNAbp introduces a DNA double-strand break in the target sequence of R1, thereby reducing the amount of R1. In some embodiments, in the presence of one or more stimuli, the napDNAbp introduces a DNA double-strand break in the target sequence of R1, thereby reducing the amount of functional reporter protein expressed in the cell. In some embodiments, the cell is contacted with the one or more stimuli for at least one, at least two, at least three, at least four, at least five, at least six, at least seven, at least eight, at least nine, at least ten, or more hours. In some embodiments, the step of determining the amount of the first recording plasmid (R1) and/or the amount of the second recording plasmid (R2) is performed one, two, three, four, five, six, seven, eight, nine, ten, or more times. In some embodiments, the step of determining the amount of the first recording plasmid (R1) and/or the amount of the second recording plasmid (R2) is performed before the cell is contacted with the one or more stimuli, and the step of determining the amount of the first recording plasmid (R1) and/or the amount of the second recording plasmid (R2) is performed at least once after the cell is contacted with the one or more stimuli.

In some embodiments, the method further comprises determining a ratio of the amount of the first recording plasmid (R1) and the amount of the second recording plasmid (R2). In some embodiments, the ratio of R1 to R2 is determined when the cell is not contacted with the one or more stimuli. In some embodiments, the ratio is determined when the cell is contacted with the one or more stimuli. In some embodiments, the cell is contacted with the one or more stimuli at least once. In some embodiments, the cell is contacted with the one or more stimuli two, three, four, five, six, seven, eight, nine, or ten times. In some embodiments, the cell is contacted with the one or more stimuli more than ten times. In some embodiments, the step of determining the ratio is performed one time after the cell has been contacted with the one or more stimuli. In some embodiments, the step of determining the ratio is performed two, three, four, five, six, seven, eight, nine, or ten times after the cell has been contacted with the one or more stimuli. In some embodiments, the cell is contacted with the one or more stimuli for at least one, at least two, at least three, at least four, at least five, at least six, at least seven, at least eight, at least nine, at least ten, or more hours. In some embodiments, the step of determining the ratio is performed before the cell is contacted with the one or more stimuli, and the step of determining the ratio is performed at least once after the cell is contacted with the one or more stimuli.

In some embodiments, the method further comprises comparing the ratio of R1 to R2 in the presence of the stimulus to the ratio of R1 to R2 in the absence of the one or more stimuli. In some embodiments, the ratio of R1 to R2 does not significantly change in the absence of the one or more stimuli. In some embodiments, a change in the ratio of R1 to R2 indicates the presence of the one or more stimuli. In some embodiments, the ratio of R1 to R2 decreases in the presence of the one or more stimuli. In some embodiments, the ratio of R1 to R2 decreases in the presence of one stimulus. In some embodiments, the ratio of R1 to R2 decreases by at least 1%, at least 5%, at least 10%, at least 15%, at least 20%, at least 25%, at least 30%, at least 35%, at least 40%, at least 45%, at least 50%, at least 55%, or at least 65% in the presence of the stimulus. In some embodiments, the ratio of R1 to R2 decreases by at least 2-fold, at least 3-fold, at least 4-fold, at least 5-fold, or more in the presence of the stimulus. In some embodiments, the ratio of R1 to R2 decreases only in the presence of two stimuli. In some embodiments, the ratio of R1 to R2 decreases by at least 1%, at least 5%, at least 10%, at least 15%, at least 20%, at least 25%, at least 30%, at least 35%, at least 40%, at least 45%, at least 50%, at least 55%, or at least 65% in the presence of the two stimuli. In some embodiments, the ratio of R1 to R2 decreases by at least 2-fold, at least 3-fold, at least 4-fold, at least 5-fold, or more in the presence of the two stimuli. In some embodiments, the ratio of R1 to R2 decreases only in the presence of more than two stimuli. In some embodiments, the ratio of R1 to R2 decreases by at least 1%, at least 5%, at least 10%, at least 15%, at least 20%, at least 25%, at least 30%, at least 35%, at least 40%, at least 45%, at least 50%, at least 55%, or at least 65% in the presence of more than two stimuli. In some embodiments, the ratio of R1 to R2 decreases by at least 2-fold, at least 3-fold, at least 4-fold, at least 5-fold, or more in the presence of more than two stimuli. In some embodiments, the step of comparing is performed when the cell is not contacted with the one or more stimuli. In some embodiments, the step of comparing is performed when the cell is contacted with the one or more stimuli. In some embodiments, the cell is contacted with the one or more stimuli at least once. In some embodiments, the cell is contacted with the one or more stimuli two, three, four, five, six, seven, eight, nine, or ten times. In some embodiments, the cell is contacted with the one or more stimuli more than ten times. In some embodiments, the step of comparing is performed one time after the cell has been contacted with the one or more stimuli. In some embodiments, the step of comparing is performed two, three, four, five, six, seven, eight, nine, or ten times after the cell has been contacted with the one or more stimuli. In some embodiments, the cell is contacted with the one or more stimuli for at least one, at least two, at least three, at least four, at least five, at least six, at least seven, at least eight, at least nine, at least ten, or more hours. In some embodiments, the step of comparing is performed before the cell is contacted with the one or more stimuli, and the step of comparing is performed at least once after the cell is contacted with the one or more stimuli.

In some embodiments, the method for recording the presence/and or duration of one or more stimuli in a cell comprises: (i) providing an engineered cell comprising the cell data recorder system; (ii) determining an amount of the first recording plasmid (R1) and an amount of the second recording plasmid (R2) in the engineered cell; (iii) determining a ratio of the amount of the first recording plasmid (R1) and the amount of the second recording plasmid (R2); and (iv) comparing the ratio of R1 to R2 in the presence of the stimulus to the ratio of R1 to R2 in the absence of the stimulus.

In some embodiments, the method further comprises resetting the amount of the first recording plasmid (R1) and the amount of the second recording plasmid (R2) in the cell. In some embodiments, R1 comprises (i) a nucleic acid sequence encoding a variant of an antibiotic resistance protein comprising one or more mutations, wherein the one or more mutations result in an antibiotic resistance protein that does not confer antibiotic resistance, and (ii) a nucleic acid sequence encoding an antibiotic resistance protein, wherein the antibiotic resistance protein confers antibiotic resistance. In some embodiments, R2 comprises (i) a nucleic acid sequence encoding a variant of an antibiotic resistance protein comprising one or more mutations, wherein the one or more mutations result in an antibiotic resistance protein that does not confer antibiotic resistance, and (ii) a nucleic acid sequence encoding an antibiotic resistance protein, wherein the antibiotic resistance protein confers antibiotic resistance. In some embodiments, the antibiotic resistance protein and variant of R1 are not identical to the antibiotic resistance protein and variant of R2. In some embodiments, R1 comprises (i) a nucleic acid sequence encoding a Cat variant comprising a H195A mutation in the amino acid sequence provided by SEQ ID NO: P1, wherein the H195A mutation results in a Cat protein that does not confer chloramphenicol resistance, and (ii) a nucleic acid sequence encoding aminoglycoside-3'-phosphotransferase (Aph3'), wherein the Aph3' protein confers kanamycin resistance. In some embodiments, R2 comprises (i) a nucleic acid sequence encoding chloramphenicol acetyltransferase (Cat), and wherein the Cat protein confers chloramphenicol resistance, and (ii) a nucleic acid sequence encoding a Aph3' protein comprising a D208A mutation in the amino acid sequence provided by SEQ ID NO: P2, and wherein the D208A mutation results in a Aph3' protein that does not confer kanamycin resistance. In some embodiments, the resetting comprises contacting the cell with a first antibiotic. In some embodiments, the cell is contacted with between 1 µg/mL and 20 µg/mL of the first antibiotic. In some embodiments, the first antibiotic is chloramphenicol. In some embodiments, the first antibiotic is kanamycin. In some embodiments, the first antibiotic reduces the amount of R1. In some embodiments, the first antibiotic is chloramphenicol. In some embodiments, the first antibiotic is kanamycin. In some embodiments, the first antibiotic reduces the amount of R2. In some embodiments, the first antibiotic is chloramphenicol. In some embodiments, the first antibiotic is kanamycin. In some embodiments, the resetting comprises contacting the cell with a second antibiotic. In some embodiments, the cell is contacted with between 1 µg/mL and 20 µg/mL of the second antibiotic. In some embodiments, the second antibiotic reduces the amount of R1. In some embodiments, the second antibiotic is chloramphenicol. In some embodiments, the second antibiotic is kanamycin. In some embodiments, the second antibiotic reduces the amount of R2. In some embodiments, the second antibiotic is chloramphenicol. In some embodiments, the second antibiotic is kanamycin. In some embodiments, the second antibiotic is different than the first antibiotic. In some embodiments, the first antibiotic is chloramphenicol and the second antibiotic is kanamycin. In some embodiments, the first antibiotic is kanamycin and the second antibiotic is chloramphenicol. In some embodiments, the resetting is achieved by contacting the cell with the first antibiotic and/or the second antibiotic for at least 6 hours, 8 hours, 10 hours, 12 hours, 24 hours, or more. In some embodiments, the cell is contacted with the first antibiotic and/or the second antibiotic at least once. In some embodiments, the cell is contacted with the first antibiotic and/or the second antibiotic at least two, at least three, at least four, at least five, at least six, at least seven, at least eight, at least nine, or at least ten times. In some embodiments, the ratio of R1 to R2 after resetting is within 1%, 2%, 3%, 4%, 5%, 6%, 7%, 8%, 9%, or 10% of the ratio of R1 to R2 after the cell has been exposed to the one or more stimuli.

In another aspect, provided herein are methods for recording the presence and/or duration of a stimulus in an engineered cell, the method comprising: (i) providing an engineered cell comprising a cell data recorder system provided herein; and (ii) determining the percentage of base editing in a target sequence of a recording plasmid (R1). In some embodiments, the engineered cell is produced by a method provided herein. In some embodiments, the cell is a prokaryotic cell. In some embodiments, the prokaryotic cell is a bacterial cell. In some embodiments, the bacterial cell is an E. coli cell (e.g., S1030 cell or S2063 cell).

In some embodiments, the writing plasmid of the cell data recorder system comprises a nucleic acid sequence encoding a fusion protein comprising a napDNAbp and a nucleic acid editing domain. In some embodiments, the napDNAbp of the cell data recorder system is associated with a sgRNA complementary to the target sequence of R1. In some embodiments, the sgRNA is encoded by the writing plasmid, and the nucleic acid sequence encoding the sgRNA is operably linked to a promoter. In some embodiments, the sgRNA is expressed by the cell. In some embodiments, the sgRNA is not encoded by the writing plasmid. In some embodiments, the sgRNA is encoded by an additional plasmid (e.g., an accessory plasmid), and the nucleic acid sequence encoding the sgRNA is operably linked to a promoter. In some embodiments, the napDNAbp is a nuclease inactive Cas9 domain. In some embodiments, the napDNAbp is a dCas9 domain. In some embodiments, the napDNAbp is a Cas9n domain. In some embodiments, the nucleic acid editing domain is a deaminase domain. In some embodiments, the deaminase domain is a cytidine deaminase domain. In some embodiments, the fusion protein comprises a dCas9 domain and a cytidine deaminase domain. In some embodiments, the fusion protein is a base editor. In some embodiments, the fusion protein edits a single base in the target sequence complementary to the sgRNA, thereby editing the recording plasmid. In some embodiments, the fusion protein introduces a single C·G to T·A mutation in the strand of the target sequence not bound by the sgRNA associated with the napDNAbp. In some embodiments, the fusion protein edits a single base in a first target sequence, thereby generating a second target sequence complementary to a different sgRNA. In some embodiments, the target sequence of R1 is present in a reporter gene encoding a functional reporter protein. In some embodiments, the functional reporter protein is a fluorescent protein. In some embodiments, the fluorescent protein is EGFP. In some embodiments, the target sequence of R1 is present in a reporter gene encoding a non-functional reporter protein. In some embodiments, the non-functional reporter protein does not produce fluorescence. In some embodiments, the target sequence of R1 is present in a reporter gene encoding a reporter protein comprising one or more insertions, deletions, and/or mutations.

In some embodiments, the percentage of base editing in a target sequence present in the recording plasmid (R1) is determined using high-throughput sequencing of the amplified target sequence. In some embodiments, the percentage of base editing is determined when the cell is not contacted with a stimulus. In some embodiments, the percentage of base editing is determined when the cell is contacted with one or more stimuli. In some embodiments, the percentage of base editing is determined when the cell is contacted with a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the stimulus is a small molecule. In some embodiments, the stimulus is an antibiotic. In some embodiments, the stimulus is a sugar. In some embodiments, the stimulus is anhydrotetracycline, IPTG, rhamnose, arabinose, tanespimycin, tunicamycin, or doxycycline. In some embodiments, the percentage of base editing is determined when the cell is contacted with two stimuli. In some embodiments, the cell is contacted with the two stimuli simultaneously. In some embodiments, the cell is contacted with the two stimuli sequentially. In some embodiments, the first stimulus induces expression of the fusion protein encoded by the writing plasmid and the second stimulus induces expression of an sgRNA encoded by the writing plasmid and/or encoded by an additional plasmid (e.g., an accessory plasmid), and wherein both stimuli are required for sgRNA association with the napDNAbp of the fusion protein. In some embodiments, the fusion protein edits a single base in the target sequence complementary to the sgRNA, thereby editing the recording plasmid. In some embodiments, the fusion protein introduces a single C·G to T·A mutation in the strand of the target sequence not bound by the sgRNA associated with the napDNAbp. In some embodiments, the two stimuli are independently a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the two stimuli are independently a small molecule. In some embodiments, the two stimuli are independently an antibiotic. In some embodiments, the two stimuli are independently a sugar. In some embodiments, the two stimuli are independently anhydrotetracycline, IPTG, rhamnose, arabinose, tanespimycin, tunicamycin, or doxycycline. In some embodiments, the cell is contacted with the one or more stimuli at least once. In some embodiments, the cell is contacted with the one or more stimuli at least two, at least three, at least four, at least five, at least six, at least seven, at least eight, at least nine, or at least ten times. In some embodiments, the cell is contacted with the one or more stimuli more than ten times. In some embodiments, in the presence of one or more stimuli, the fusion protein edits a base in the target sequence, thereby increasing the percentage of base editing in the target sequence. In some embodiments, the cell is contacted with the one or more stimuli for at least one, at least two, at least three, at least four, at least five, at least six, at least seven, at least eight, at least nine, at least ten, or more hours. In some embodiments, the step of determining the percentage of base editing is performed one, two, three, four, five, six, seven, eight, nine, ten, or more times. In some embodiments, the step of determining the percentage of base editing is performed before the cell is contacted with the one or more stimuli, and the step of determining percentage of base editing is performed at least once after the cell is contacted with the one or more stimuli.

In some embodiments, the method further comprises comparing the percentage of base editing in the target sequence in the presence of the stimulus to the percentage of base editing in the target sequence in the absence of the one or more stimuli. In some embodiments, the percentage of base editing in the target sequence does not significantly change in the absence of the one or more stimuli. In some embodiments, a change in the percentage of base editing in the target sequence indicates the presence of the one or more stimuli. In some embodiments, the percentage of base editing in the target sequence increases in the presence of the one or more stimuli. In some embodiments, the percentage of base editing in the target sequence increases in the presence of one stimulus. In some embodiments, the percentage of base editing in the target sequence increases by at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 80%, at least 85%, or more in the presence of the stimulus. In some embodiments, the percentage of base editing in the target sequence increases by at least 2-fold, at least 3-fold, at least 4-fold, at least 5-fold, or more in the presence of the stimulus. In some embodiments, the percentage of base editing in the target sequence increases only in the presence of two stimuli. In some embodiments, the percentage of base editing in the target sequence increases by at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 80%, at least 85%, or more in the presence of the two stimuli. In some embodiments, the percentage of base editing in the target sequence increases by at least 2-fold, at least 3-fold, at least 4-fold, at least 5-fold, or more in the presence of the two stimuli. In some embodiments, the percentage of base editing in the target sequence increases only in the presence of more than two stimuli. In some embodiments, the percentage of base editing in the target sequence increases by at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 80%, at least 85%, or more in the presence of more than two stimuli. In some embodiments, the percentage of base editing in the target sequence increases by at least 2-fold, at least 3-fold, at least 4-fold, at least 5-fold, or more in the presence of more than two stimuli. In some embodiments, the step of comparing is performed when the cell is not contacted with the one or more stimuli. In some embodiments, the step of comparing is performed when the cell is contacted with the one or more stimuli. In some embodiments, the cell is contacted with the one or more stimuli at least once. In some embodiments, the cell is contacted with the one or more stimuli two, three, four, five, six, seven, eight, nine, or ten times. In some embodiments, the cell is contacted with the one or more stimuli more than ten times. In some embodiments, the step of comparing is performed one time after the cell has been contacted with the one or more stimuli. In some embodiments, the step of comparing is performed two, three, four, five, six, seven, eight, nine, or ten times after the cell has been contacted with the one or more stimuli. In some embodiments, the cell is contacted with the one or more stimuli for at least one, at least two, at least three, at least four, at least five, at least six, at least seven, at least eight, at least nine, at least ten, or more hours. In some embodiments, the step of comparing is performed before the cell is contacted with the one or more stimuli, and the step of comparing is performed at least once after the cell is contacted with the one or more stimuli.

In some embodiments, the method for recording the presence/and or duration of one or more stimuli in a cell comprises: (i) providing an engineered cell comprising the cell data recorder system; (ii) determining the percentage of base editing in a target sequence of a recording plasmid (R1); and (iii) comparing the percentage of base editing in the target sequence in the presence of the stimulus to the percentage of base editing in the absence of the stimulus.

In another aspect, provided herein are methods for recording the presence and/or duration of a stimulus in an engineered cell, the method comprising: (i) providing an engineered cell comprising a cell data recorder system provided herein; and (ii) determining the percentage of base editing in a target sequence of one or more recording loci. In some embodiments, the engineered cell is produced by a method provided herein. In some embodiments, the cell is a eukaryotic cell. In some embodiments, the eukaryotic cell is a mammalian cell. In some embodiments, the mammalian cell is a human cell (e.g., HEK293T cell).

In some embodiments, the writing plasmid of the cell data recorder system comprises a nucleic acid sequence encoding a fusion protein comprising a napDNAbp and a nucleic acid editing domain. In some embodiments, the napDNAbp of the cell data recorder system is associated with a sgRNA complementary to the target sequence of the recording locus. In some embodiments, the sgRNA is encoded by the writing plasmid, and the nucleic acid sequence encoding the sgRNA is operably linked to a promoter. In some embodiments, the sgRNA is expressed by the cell. In some embodiments, the sgRNA is not encoded by the writing plasmid. In some embodiments, the sgRNA is encoded by an additional plasmid (e.g., an accessory plasmid), and the nucleic acid sequence encoding the sgRNA is operably linked to a promoter. In some embodiments, the napDNAbp is a nuclease inactive Cas9 domain. In some embodiments, the napDNAbp is a dCas9 domain. In some embodiments, the napDNAbp is a Cas9n domain. In some embodiments, the nucleic acid editing domain is a deaminase domain. In some embodiments, the deaminase domain is a cytidine deaminase domain. In some embodiments, the fusion protein comprises a dCas9 domain and a cytidine deaminase domain. In some embodiments, the fusion protein is a base editor. In some embodiments, the fusion protein edits a single base in the target sequence complementary to the sgRNA, thereby editing the recording plasmid. In some embodiments, the fusion protein introduces a single C·G to T·A mutation in the strand of the target sequence not bound by the sgRNA associated with the napDNAbp. In some embodiments, the fusion protein edits a single base in a first target sequence, thereby generating a second target sequence complementary to a different sgRNA. In some embodiments, the one or more of the recording loci are located in a safe harbor locus. In some embodiments, the safe harbor locus is located in the CCR5 gene. In some embodiments, the CCR5 gene is a human CCR5 gene.

In some embodiments, the percentage of base editing in the recording locus is determined using high-throughput sequencing of the amplified target sequence. In some embodiments, the percentage of base editing is determined when the cell is not contacted with a stimulus. In some embodiments, the percentage of base editing is determined when the cell is contacted with one or more stimuli. In some embodiments, the percentage of base editing is determined when the cell is contacted with a stimulus. In some embodiments, the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the stimulus is a small molecule. In some embodiments, the stimulus is an antibiotic. In some embodiments, the stimulus is a sugar. anhydrotetracycline, IPTG, rhamnose, arabinose, tanespimycin, tunicamycin, or doxycycline. In some embodiments, the percentage of base editing is determined when the cell is contacted with two stimuli. In some embodiments, the cell is contacted with the two stimuli simultaneously. In some embodiments, the cell is contacted with the two stimuli sequentially. In some embodiments, the first stimulus induces expression of the fusion protein encoded by the writing plasmid and the second stimulus induces expression of an sgRNA encoded by the writing plasmid and/or encoded by an additional plasmid (e.g., an accessory plasmid), and wherein both stimuli are required for sgRNA association with the napDNAbp of the fusion protein. In some embodiments, the fusion protein edits a single base in the target sequence complementary to the sgRNA, thereby editing the recording plasmid. In some embodiments, the fusion protein introduces a single C·G to T·A mutation in the strand of the target sequence not bound by the sgRNA associated with the napDNAbp. In some embodiments, the two stimuli are independently a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state. In some embodiments, the two stimuli are independently a small molecule. In some embodiments, the two stimuli are independently an antibiotic. In some embodiments, the two stimuli are independently a sugar. In some embodiments, the two stimuli are independently anhydrotetracycline, IPTG, rhamnose, arabinose, tanespimycin, tunicamycin, or doxycycline. In some embodiments, the cell is contacted with the one or more stimuli at least once. In some embodiments, the cell is contacted with the one or more stimuli at least two, at least three, at least four, at least five, at least six, at least seven, at least eight, at least nine, or at least ten times. In some embodiments, the cell is contacted with the one or more stimuli more than ten times. In some embodiments, in the presence of one or more stimuli, the fusion protein edits a base in the target sequence, thereby increasing the percentage of base editing in the target sequence. In some embodiments, the cell is contacted with the one or more stimuli for at least one, at least two, at least three, at least four, at least five, at least six, at least seven, at least eight, at least nine, at least ten, or more hours. In some embodiments, the step of determining the percentage of base editing is performed one, two, three, four, five, six, seven, eight, nine, ten, or more times. In some embodiments, the step of determining the percentage of base editing is performed before the cell is contacted with the one or more stimuli, and the step of determining percentage of base editing is performed at least once after the cell is contacted with the one or more stimuli.

In some embodiments, the method further comprises comparing the percentage of base editing in the target sequence in the presence of the stimulus to the percentage of base editing in the target sequence in the absence of the one or more stimuli. In some embodiments, the percentage of base editing in the target sequence does not significantly change in the absence of the one or more stimuli. In some embodiments, a change in the percentage of base editing in the target sequence indicates the presence of the one or more stimuli. In some embodiments, the percentage of base editing in the target sequence increases in the presence of the one or more stimuli. In some embodiments, the percentage of base editing in the target sequence increases in the presence of one stimulus. In some embodiments, the percentage of base editing in the target sequence increases by at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 80%, at least 85%, or more in the presence of the stimulus. In some embodiments, the percentage of base editing in the target sequence increases by at least 2-fold, at least 3-fold, at least 4-fold, at least 5-fold, or more in the presence of the stimulus. In some embodiments, the percentage of base editing in the target sequence increases only in the presence of two stimuli. In some embodiments, the percentage of base editing in the target sequence increases by at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 80%, at least 85%, or more in the presence of the two stimuli. In some embodiments, the percentage of base editing in the target sequence increases by at least 2-fold, at least 3-fold, at least 4-fold, at least 5-fold, or more in the presence of the two stimuli. In some embodiments, the percentage of base editing in the target sequence increases only in the presence of more than two stimuli. In some embodiments, the percentage of base editing in the target sequence increases by at least 1%, at least 5%, at least 10%, at least 15%, at least 20%, at least 25%, at least 30%, at least 35%, at least 40%, at least 45%, at least 50%, at least 55%, at least 60%, at least 65%, at least 70%, at least 80%, at least 85%, or more in the presence of more than two stimuli. In some embodiments, the percentage of base editing in the target sequence increases by at least 2-fold, at least 3-fold, at least 4-fold, at least 5-fold, or more in the presence of more than two stimuli. In some embodiments, the step of comparing is performed when the cell is not contacted with the one or more stimuli. In some embodiments, the step of comparing is performed when the cell is contacted with the one or more stimuli. In some embodiments, the cell is contacted with the one or more stimuli at least once. In some embodiments, the cell is contacted with the one or more stimuli two, three, four, five, six, seven, eight, nine, or ten times. In some embodiments, the cell is contacted with the one or more stimuli more than ten times. In some embodiments, the step of comparing is performed one time after the cell has been contacted with the one or more stimuli. In some embodiments, the step of comparing is performed two, three, four, five, six, seven, eight, nine, or ten times after the cell has been contacted with the one or more stimuli. In some embodiments, the cell is contacted with the one or more stimuli for at least one, at least two, at least three, at least four, at least five, at least six, at least seven, at least eight, at least nine, at least ten, or more hours. In some embodiments, the step of comparing is performed before the cell is contacted with the one or more stimuli, and the step of comparing is performed at least once after the cell is contacted with the one or more stimuli.

In some embodiments, the method for recording the presence/and or duration of one or more stimuli in a cell comprises: (i) providing an engineered cell comprising the cell data recorder system; (ii) determining the percentage of base editing in a target sequence of a recording locus; and (iii) comparing the percentage of base editing in the target sequence in the presence of the stimulus to the percentage of base editing in the absence of the stimulus.

Nucleic Acid Programmable DNA Binding Proteins

Some aspects of this disclosure provide nucleic acid programmable DNA binding proteins (napDNAbps) that target DNA in a specific and programmable manner. These napDNAbps can associate with a guide RNA (gRNA) or single guide RNA (sgRNA) that comprises a nucleic acid sequence (e.g., RNA) that is complementary to a target sequence of interest (e.g., a sequence comprising a target site). A napDNAbp that is guided to a target by a gRNA sequence may be referred to as an RNA-programmable nuclease. In some embodiments, the RNA-programmable nuclease is a Cas9 domain (e.g., a Cas9 nuclease). In some embodiments, the RNA-programmable nuclease is programmed (i.e., directed) to bind to a target DNA sequence (e.g., in a plasmid or a gene). In some embodiments, the Cas9 domain is a Cas9 nuclease. Upon hybridization with the target DNA sequence, the Cas9 nuclease introduces a double-strand break in the target DNA sequence. In some embodiments, the Cas9 domain is a catalytically inactive dCas9 domain. Upon hybridization with the target DNA sequence, the catalytically inactive dCas9 domain cannot introduce a double-strand break in the target DNA sequence. In some embodiments, the Cas9 domain is a catalytically inactive Cas9n domain. Upon hybridization with the target DNA sequence, the catalytically inactive Cas9n domain introduces a single-strand break (i.e., a nick) in the target DNA sequence.

Non-limiting, exemplary Cas9 domains are provided herein. The Cas9 domain may be a nuclease active Cas9 domain, a nuclease inactive Cas9 domain, or a Cas9 nickase domain. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises the amino acid sequence set forth in SEQ ID NO: 10. In some embodiments, the Cas9 domain comprises any one of the amino acid sequences as set forth in SEQ ID NOs: 11-260. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in SEQ ID NOs: 10-260. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more or more mutations compared to any one of the amino acid sequences set forth in SEQ ID NOs: 10-260. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 10-260. In some embodiments, the Cas9 domain of any of the fusion proteins provided herein comprises of the amino acid sequence of any one of SEQ ID NOs: 10-260. In some embodiments, the Cas9 domain of any of the fusion proteins provided herein consists of the amino acid sequence of any one of SEQ ID NOs: 10-260.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 10, or a corresponding mutation in any of the amino acid sequences provided in SEQ ID NOs: 11-260, wherein X is any amino acid change. In some embodiments, the nuclease-inactive dCas9 domain comprises a D10A mutation and a H840A mutation of the amino acid sequence set forth in SEQ ID NO: 10, or a corresponding mutation in any of the amino acid sequences provided in SEQ ID NOs: 11-260. For example, a nuclease-inactive Cas9 domain (dCas9) comprises the amino acid sequence set forth in SEQ ID NO: 6. In some embodiments, the dCas9 domain of any of the fusion proteins provided herein comprises of the amino acid sequence of SEQ ID NOs: 6. In some embodiments, the dCas9 domain of any of the fusion proteins provided herein consists of the amino acid sequence of SEQ ID NO: 6. As another example, a nuclease-inactive Cas9 domain comprises the amino acid sequence set forth in SEQ ID NO: 9 (Cloning vector pPlatTET-gRNA2, Accession No. BAV54124).

```
MDKKYSIGLAIGTNSVGWAVITDEYKVPSKKEKVLGNTDRHSIKKNLIG

ALLEDSGETAEATRLKRTARRRYTRRKNRICYLQEIFSNEMAKVDDSFE

HRLEESELVEEDKKHERHPIEGNIVDEVAYHEKYPTIYHLRKKLVDSTD

KADLRLIYLALAHMIKERGHFLIEGDLNPDNSDVDKLFIQLVQTYNQLF

EENPINASGVDAKAILSARLSKSRRLENLIAQLPGEKKNGLEGNLIALS

LGLIPNEKSNEDLAEDAKLQLSKDTYDDDLDNLLAQIGDQYADLFLAAK

NLSDAILLSDILRVNTEITKAPLSASMIKRYDEHHQDLILLKALVRQQL

PEKYKEIFEDQSKNGYAGYIDGGASQEEFYKFIKPILEKMDGTEELLVK

LNREDLLRKQRTEDNGSIPHQIHLGELHAILRRQEDFYPFLKDNREKIE

KILTFRIPYYVGPLARGNSRFAWMTRKSEETITPWNFEEVVDKGASAQS

FIERMTNEDKNLPNEKVLPKHSLLYEYFTVYNELTKVKYVTEGMRKPAE

LSGEQKKAIVDLLEKTNRKVTVKQLKEDYFKKIECEDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTEKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDAIVPQSFLKDDSIDNKVLIRSDKNRGKSDNVPSEEVVKKMKNY

WRQLLNAKLITQRKEDNLTKAERGGLSELDKAGFIKRQLVETRQIIKHV

AQILDSRMNIKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFEKTEITLANGEIRKRPLIETNGETGEIVWDKGR

DFATVRKVLSMPQVNIVKKTEVQTGGESKESILPKRNSDKLIARKKDWD

PKKYGGEDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (SEQ ID NO: 9; see, e.g., Qi et al., Repurposing CRISPR as an RNA-guided platform for sequence-specific control of gene expression. Cell. 2013;

52(5):1173-83, the entire contents of which are incorporated herein by reference).
```

(SEQ ID NO: 9; see, e.g., Qi et al., Repurposing CRISPR as an RNA-guided platform for sequence-specific control of gene expression. Cell. 2013; 152(5):1173-83, the entire contents of which are incorporated herein by reference).

Additional suitable nuclease-inactive dCas9 domains will be apparent to those of ordinary skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (see, e.g., Prashant et al., CAS9 transcriptional activators for target specificity screening and paired nickases for cooperative genome engineering. Nature Biotechnology. 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the dCas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more or more mutations compared to any one of the amino acid sequences set forth in SEQ ID NOs: 10-260. In some embodiments, the dCas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 10-260.

In some embodiments, the Cas9 domain is a Cas9 nickase (Cas9n). The Cas9 nickase may be a Cas9 protein that is capable of cleaving only one strand of a duplexed nucleic acid molecule (e.g., a duplexed DNA molecule). In some embodiments, the Cas9 nickase cleaves the target strand of a duplexed target nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 10, or the corresponding mutation in any of SEQ ID NOs: 11-260. For example, a Cas9 nickase may comprise the amino acid sequence as set forth in SEQ ID NO: 7. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 10, or a corresponding mutation in any of SEQ ID NOs: 11-260. For example, a Cas9 nickase may comprise the amino acid sequence as set forth in SEQ ID NO: 8. In some embodiments, the Cas9n domain of any of the fusion proteins provided herein comprises of the amino acid sequence of SEQ ID NOs: 7. In some embodiments, the Cas9n domain of any of the fusion proteins provided herein consists of the amino acid sequence of SEQ ID NO: 7. In some embodiments, the Cas9n domain of any of the fusion proteins provided herein comprises of the amino acid sequence of SEQ ID NOs: 8. In some embodiments, the Cas9n domain of any of the fusion proteins provided herein consists of the amino acid sequence of SEQ ID NO: 8. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of ordinary skill in the art based on this disclosure and knowledge in the field, and are within the scope of this disclosure.

In some embodiments, a Cas9 nickase may further facilitate the removal of a base on the non-edited strand in an organism whose genome is edited in vivo. The Cas9 nickase, as described herein, may comprise a D10A mutation in SEQ ID NO: 10, or a corresponding mutation in any of SEQ ID NOs: 11-260. In some embodiments, the Cas9 nickase of this disclosure may comprise a histidine at mutation 840 of SEQ ID NO: 10, or a corresponding residue in any of SEQ ID NOs: 11-260. Such fusion proteins comprising the Cas9 nickase can cleave a single strand of the target DNA sequence, e.g., the strand that is not being edited. Without wishing to be bound by any particular theory, this cleavage may inhibit mis-match repair mechanisms that reverse a C to U edit made by the cytidine deaminase, ultimately resulting in a C to T change as directed by a cytidine deaminase. As another example, the presence of the catalytic residue (e.g., H840) maintains the activity of the Cas9 to cleave the non-edited (e.g., non-deaminated) strand containing a T opposite a targeted A nucleobase. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand as directed by an adenosine deaminase.

Some aspects of the disclosure provide Cas9 domains that have different PAM specificities, such as, for example, Cas9 domains from *Staphylococcus aureus*. Typically, Cas9 proteins, such as Cas9 from *S. pyogenes* (spCas9), require a canonical 5'-NGG-3' PAM sequence to bind a particular nucleic acid region. This may limit the ability to edit desired bases within a genome. In some embodiments, the base editing fusion proteins provided herein may need to be placed at a precise location, for example where a target base is placed within a 4 base region (e.g., a "deamination window"), which is approximately 15 bases upstream of the PAM. See Komor et al., "Programmable editing of a target base in genomic DNA without double-stranded DNA cleavage" *Nature* 533, 420-424 (2016), the entire contents of which is hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver et al., "Engineered CRISPR-Cas9 nucleases with altered PAM specificities" *Nature* 523, 481-485 (2015); and Kleinstiver et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference. In addition, evolved, recombinant Cas9 domains with broadened PAM exclusivity are described in International Patent Application No. PCT/US2016/058345, filed Oct. 22, 2016, published as WO2017/070633 on Apr. 27, 2017, entitled "Evolved Cas9 Proteins for Gene Editing." the entire contents of which is incorporated herein by reference.

```
Exemplary SpCas9
                                                         (SEQ ID NO: 261)
DKKYSIGLDIGTNSVGWAVITDEYKVPSKKFKVLGNIDRHSIKKNLIGALLFDSGETAEATRLKRTARRRYTRR

KNRICYLQEIFSNEMAKVDDSFFHRLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEENPINASGVDAKAILSARLSKSRRLE

NLIAQLPGEKKNGLFGNLIALSLGLIPNEKSNFDLAEDAKLQLSKDTYDDDLDNLLAQIGDQYADLFLAAKNLS
```

-continued

DAILLSDILRVNTEITKAPLSASMIKRYDEHHQDLTLLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNREKIEKILT

FRIPYYVGPLARGNSRFAWMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFDSVEISGVEDRFNASLGT

YHDLLKIIKDKDFLDNEENEDILEDIVLTLTLFEDREMIEERLKTYAHLFDDKVMKQLKRRRYTGWGRLSRKLI

NGIRDKQSGKTILDFLKSDGFANRNFMQLIHDDSLTFKEDIQKAQVSGQGDSLHEHIANLAGSPAIKKGILQTV

KVVDELVKVMGRHKPENIVIEMARENQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRMNTKYDENDKLIREVKVITLKSKLV

SDFRKDFQFYKVREINNYHHAHDAYLNAVVGIALIKKYPKLESEFVYGDYKVYDVRKMIAKSEQEIGKATAKYF

FYSNIMNFEKTEITLANGEIRKRPLIETNGETGEIVWDKGRDFATVRKVLSMPQVNIVKKTEVQTGGESKESIL

PKRNSDKLIARKKDWDPKKYGGFDSPIVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHYEKLKGSPEDNEQKQLFV

EQHKHYLDEIIEQISEFSKRVILADANLDKVLSAYNKHRDKPIREQAENIIHLFTLINLGAPAAFKYFDTTIDR

KRYISTKEVLDATLIHQSITGLYETRIDLSQLGGD

Exemplary SpCas9n
(SEQ ID NO: 262)
DKKYSIGLAIGTNSVGWAVITDEYKVPSKKFKVLGNIDRHSIKKNLIGALLFDSGETAEATRLKRTARRRYTRR

KNRICYLQEIFSNEMAKVDDSFFHRLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEENPINASGVDAKAILSARLSKSRRLE

NLIAQLPGEKKNGLFGNLIALSLGLIPNEKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNREKIEKILT

FRIPYYVGPLARGNSRFAWMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFDSVEISGVEDRFNASLGT

YHDLLKIIKDKDFLDNEENEDILEDIVLTLTLFEDREMIEERLKTYAHLFDDKVMKQLKRRRYTGWGRLSRKLI

NGIRDKQSGKTILDFLKSDGFANRNFMQLIHDDSLTFKEDIQKAQVSGQGDSLHEHIANLAGSPAIKKGILQTV

KVVDELVKVMGRHKPENIVIEMARENQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRMNTKYDENDKLIREVKVITLKSKLV

SDFRKDFQFYKVREINNYHHAHDAYLNAVVGIALIKKYPKLESEFVYGDYKVYDVRKMIAKSEQEIGKATAKYF

FYSNIMNFEKTEITLANGEIRKRPLIETNGETGEIVWDKGRDFATVRKVLSMPQVNIVKKTEVQTGGESKESIL

PKRNSDKLIARKKDWDPKKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHYEKLKGSPEDNEQKQLFV

EQHKHYLDEIIEQISEFSKRVILADANLDKVLSAYNKHRDKPIREQAENIIHLFTLINLGAPAAFKYFDTTIDR

KRYISTKEVLDATLIHQSITGLYETRIDLSQLGGD

Exemplary SpEQR Cas9
(SEQ ID NO: 263)
DKKYSIGLAIGTNSVGWAVITDEYKVPSKKFKVLGNIDRHSIKKNLIGALLFDSGETAEATRLKRTARRRYTRR

KNRICYLQEIFSNEMAKVDDSFFHRLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEENPINASGVDAKAILSARLSKSRRLE

NLIAQLPGEKKNGLFGNLIALSLGLIPNEKSNFDLAEDAKLQLSKDTYDDDLDNLLAQIGDQYADLFLAAKNLS

-continued

```
DAILLSDILRVNTEITKAPLSASMIKRYDEHHQDLTLLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNREKIEKILT

FRIPYYVGPLARGNSRFAWMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFDSVEISGVEDRFNASLGT

YHDLLKIIKDKDFLDNEENEDILEDIVLTLTLFEDREMIEERLKTYAHLFDDKVMKQLKRRYTGWGRLSRKLI

NGIRDKQSGKTILDFLKSDGFANRNFMQLIHDDSLTFKEDIQKAQVSGQGDSLHEHIANLAGSPAIKKGILQTV

KVVDELVKVMGRHKPENIVIEMARENQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRMNTKYDENDKLIREVKVITLKSKLV

SDFRKDFQFYKVREINNYHHAHDAYLNAVVGIALIKKYPKLESEFVYGDYKVYDVRKMIAKSEQEIGKATAKYF

FYSNIMNFEKTEITLANGEIRKRPLIETNGETGEIVWDKGRDFATVRKVLSMPQVNIVKKTEVQTGGESKESIL

PKRNSDKLIARKKDWDPKKYGGFESPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHYEKLKGSPEDNEQKQLFV

EQHKYHLDEIIEQISEFSKRVILADANLDKVLSAYNKHRDKPIREQAENIIHLFTLINLGAPAAFKYFDTTIDR

KQYR**STKEVLDATLIHQSITGLYETRIDLSQLGGD
```

Residues E1134, Q1334, and R1336 of SEQ ID NO: 4278, which can be mutated from D1134, R1334, and T1336 of SEQ ID NO: 4278 to yield a SpEQR Cas9, are underlined and in bold.

Exemplary SpVQR Cas9

(SEQ ID NO: 264)

```
DKKYSIGLAIGTNSVGWAVITDEYKVPSKKFKVLGNIDRHSIKKNLIGALLFDSGETAEATRLKRTARRRYTRR

KNRICYLQEIFSNEMAKVDDSFFHRLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEENPINASGVDAKAILSARLSKSRRLE

NLIAQLPGEKKNGLFGNLIALSLGLIPNEKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNREKIEKILT

FRIPYYVGPLARGNSRFAWMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFDSVEISGVEDRFNASLGT

YHDLLKIIKDKDFLDNEENEDILEDIVLTLTLFEDREMIEERLKTYAHLFDDKVMKQLKRRYTGWGRLSRKLI

NGIRDKQSGKTILDFLKSDGFANRNFMQLIHDDSLTFKEDIQKAQVSGQGDSLHEHIANLAGSPAIKKGILQTV

KVVDELVKVMGRHKPENIVIEMARENQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRMNTKYDENDKLIREVKVITLKSKLV

SDFRKDFQFYKVREINNYHHAHDAYLNAVVGIALIKKYPKLESEFVYGDYKVYDVRKMIAKSEQEIGKATAKYF

FYSNIMNFEKTEITLANGEIRKRPLIETNGETGEIVWDKGRDFATVRKVLSMPQVNIVKKTEVQTGGESKESIL

PKRNSDKLIARKKDWDPKKYGGFVSPTVAYSVLVVAKVEKGKSKKLKSVKELLGITIMERSSFEKNPIDFLEAK
```

```
-continued
GYKEVKKDLIIKLPKYSLFELENGRKRMLASAGELQKGNELALPSKYVNFLYLASHYEKLKGSPEDNEQKQLFV

EQHKHYLDEIIEQISEFSKRVILADANLDKVLSAYNKHRDKPIREQAENIIHLFTLINLGAPAAFKYFDTTIDR

KQYRSTKEVLDATLIHQSITGLYETRIDLSQLGGD

Residues V1134, Q1334, and R1336 of SEQ ID NO: 4279, which can be mutated from D1134, R1334, and T1336 of SEQ ID NO: 4279 to yield a SpVQR Cas9, are underlined and in bold.

Exemplary SpVRER Cas9
DKKYSIGLAIGTNSVGWAVITDEYKVPSKKFKVLGNIDRHSIKKNLIGALLFDSGETAEATRLKRTARRRYTRR

KNRICYLQEIFSNEMAKVDDSFFHRLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEENPINASGVDAKAILSARLSKSRRLE

NLIAQLPGEKKNGLFGNLIALSLGLIPNEKSNFDLAEDAKLQLSKDTYDDDLDNLLAQIGDQYADLFLAAKNLS

DAILLSDILRVNTEITKAPLSASMIKRYDEHHQDLILLKALVRQQLPEKYKEIFFDQSKNGYAGYIDGGASQEE

FYKFIKPILEKMDGTEELLVKLNREDLLRKQRTFDNGSIPHQIHLGELHAILRRQEDFYPFLKDNREKIEKILT

FRIPYYVGPLARGNSRFAWMTRKSEETITPWNFEEVVDKGASAQSFIERMINFDKNLPNEKVLPKHSLLYEYFT

VYNELTKVKYVTEGMRKPAFLSGEQKKAIVDLLFKINRKVTVKQLKEDYFKKIECFDSVEISGVEDRFNASLGT

YHDLLKIIKDKDFLDNEENEDILEDIVLILTLFEDREMIEERLKTYAHLFDDKVMKQLKRRRYTGWGRLSRKLI

NGIRDKQSGKTILDFLKSDGFANRNFMQLIHDDSLIFKEDIQKAQVSGQGDSLHEHIANLAGSPAIKKGILQTV

KVVDELVKVMGRHKPENIVIEMARENQTTQKGQKNSRERMKRIEEGIKELGSQILKEHPVENTQLQNEKLYLYY

LQNGRDMYVDQELDINRLSDYDVDHIVPQSFLKDDSIDNKVLIRSDKNRGKSDNVPSEEVVKKMKNYWRQLLNA

KLITQRKFDNLTKAERGGLSELDKAGFIKRQLVETRQIIKHVAQILDSRMNTKYDENDKLIREVKVITLKSKLV

SDFRKDFQFYKVREINNYHHAHDAYLNAVVGIALIKKYPKLESEFVYGDYKVYDVRKMIAKSEQEIGKATAKYF

FYSNIMNFEKTEITLANGEIRKRPLIETNGETGEIVWDKGRDFATVRKVLSMPQVNIVKKTEVQTGGESKESIL

PKRNSDKLIARKKDWDPKKYGGFVSPTVAYSVLVVAKVEKGKSKKLKSVKELLGITIMERSSFEKNPIDFLEAK

GYKEVKKDLIIKLPKYSLFELENGRKRMLASARELQKGNELALPSKYVNFLYLASHYEKLKGSPEDNEQKQLFV

EQHKHYLDEIIEQISEFSKRVILADANLDKVLSAYNKHRDKPIREQAENIIHLFTLINLGAPAAFKYFDTTIDR

KEYRSTKEVLDATLIHQSITGLYETRIDLSQLGGD (SEQ ID NO: 265; residues V1134, R1217,

Q1334, and R1336 of SEQ ID NO: 265, which can be mutated from D1134, G1217,

R1334, and T1336 of SEQ ID NO: 265 to yield a SpVRER Cas9, are underlined and in bold.)
```

In some embodiments, the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 261-265. In some embodiments, the Cas9 domain comprises the amino acid sequence of any one of SEQ ID NOs: 261-265. In some embodiments, the Cas9 domain consists of the amino acid sequence of any one of SEQ ID NOs: 261-265.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 261-265. In some embodiments, the Cas9 domain of any of the fusion proteins provided herein comprises the amino acid sequence of any one of SEQ ID NOs: 261-265. In some embodiments, the Cas9 domain of any of the fusion proteins provided herein consists of the amino acid sequence of any one of SEQ ID NOs: 261-265. Exemplary, non-limiting examples of fusion proteins comprising a Cas9 domain comprising the amino acid sequence of any one of SEQ ID NOs: 261-265 are described in International Patent Application No. PCT/US2016/058344, filed Oct. 22, 2016, and published as Publication No. WO2017/070632 on Apr. 27, 2017, the entire contents of which are incorporated herein by reference.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 261. In some embodiments, the SpCas9 comprises a D9X mutation of SEQ ID NO: 261, or a corresponding mutation in any of the amino acid sequences provided in SEQ ID NOs: 10-260, wherein X is any amino acid except for D. In some embodiments, the SpCas9 comprises a D9A mutation of SEQ ID NO: 261, or a corresponding mutation in any of the amino acid sequences provided in SEQ ID NOs: 10-260. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 4276, or a corresponding mutation in any of the amino acid sequences provided in SEQ ID NOs: 11-260, wherein X is any amino acid. In some embodiments, the SpCas9 domain comprises one or more of a D1134E, R1334Q, and T1336R mutation of SEQ ID NO: 4276, or a corresponding mutation in any of the amino acid sequences provided in SEQ ID NOs: 11-260. In some embodiments, the SpCas9 domain comprises a D1134E, a R1334Q, and a T1336R mutation of SEQ ID NO: 4276, or corresponding mutations in any of the amino acid sequences provided in SEQ ID NOs: 11-260. In some embodiments, the SpCas9 domain comprises one or more of a D1134X, a R1334X, and a T1336X mutation of SEQ ID NO: 4276, or a corresponding mutation in any of the amino acid sequences provided in SEQ ID NOs: 11-260, wherein X is any amino acid. In some embodiments, the SpCas9 domain comprises one or more of a D1134V, a R1334Q, and a T1336R mutation of SEQ ID NO: 4276, or a corresponding mutation in any of the amino acid sequences provided in SEQ ID NOs: 11-260. In some embodiments, the SpCas9 domain comprises a D1134V, a R1334Q, and a T1336R mutation of SEQ ID NO: 4276, or corresponding mutations in any of the amino acid sequences provided in SEQ ID NOs: 11-260. In some embodiments, the SpCas9 domain comprises one or more of a D1134X, a G1217X, a R1334X, and a T1336X mutation of SEQ ID NO: 4276, or a corresponding mutation in any of the amino acid sequences provided in SEQ ID NOs: 11-260, wherein X is any amino acid. In some embodiments, the SpCas9 domain comprises one or more of a D1134V, a G1217R, a R1334Q, and a T1336R mutation of SEQ ID NO: 4276, or a corresponding mutation in any of the amino acid sequences provided in SEQ ID NOs: 11-260. In some embodiments, the SpCas9 domain comprises a D1134V, a G1217R, a R1334Q, and a T1336R mutation of SEQ ID NO: 4276, or corresponding mutations in any of the amino acid sequences provided in SEQ ID NOS: 11-260.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 266. In some embodiments, the SaCas9 comprises a N579X mutation of SEQ ID NO: 266, or a corresponding mutation in any of the amino acid sequences provided in SEQ ID NOs: 10-260, wherein X is any amino acid except for N. In some embodiments, the SaCas9 comprises a N579A mutation of SEQ ID NO: 266, or a corresponding mutation in any of the amino acid sequences provided in SEQ ID NOs: 10-260. In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation of SEQ ID NO: 266, or a corresponding mutation in any of the amino acid sequences provided in SEQ ID NOs: 10-260, wherein X is any amino acid. In some embodiments, the SaCas9 domain comprises one or more of a E781K, a N967K, and a R1014H mutation of SEQ ID NO: 266, or one or more corresponding mutation in any of the amino acid sequences provided in SEQ ID NOs: 10-260. In some embodiments, the SaCas9 domain comprises a E781K, a N967K, or a R1014H mutation of SEQ ID NO: 266, or corresponding mutations in any of the amino acid sequences provided in SEQ ID NOs: 10-260.

In some embodiments, the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 266-268. In some embodiments, the Cas9 domain comprises the amino acid sequence of any one of SEQ ID NOs: 266-268. In some embodiments, the Cas9 domain consists of the amino acid sequence of any one of SEQ ID NOs: 266-268.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 266-268. In some embodiments, the Cas9 domain of any of the fusion proteins provided herein comprises the amino acid sequence of any one of SEQ ID NOs: 266-268. In some embodiments, the Cas9 domain of any of the fusion proteins provided herein consists of the amino acid sequence of any one of SEQ ID NOs: 266-268. Exemplary, non-limiting examples of fusion proteins comprising a Cas9 domain comprising the amino acid sequence of any one of SEQ ID NOs: 266-268 are described in International Patent Application No. PCT/US2016/058344, filed Oct. 22, 2016, and published as Publication No. WO2017/070632 on Apr. 27, 2017, the entire contents of which are incorporated herein by reference.

```
Exemplary SaCas9 sequence
                                                            (SEQ ID NO: 266)
KRNYILGLDIGITSVGYGIIDYETRDVIDAGVRLFKEANVENNEGRRSKRGARRLKRRRRHRIQRVKKLLFDYN

LLTDHSELSGINPYEARVKGLSQKLSEEEFSAALLHLAKRRGVHNVNEVEEDIGNELSTKEQISRNSKALEEKY

VAELQLERLKKDGEVRGSINRFKISDYVKEAKQLLKVQKAYHQLDQSFIDTYIDLLETRRTYYEGPGEGSPFGW

KDIKEWYEMLMGHCTYFPEELRSVKYAYNADLYNALNDLNNLVITRDENEKLEYYEKFQIIENVFKQKKKPTLK

QIAKEILVNEEDIKGYRVTSTGKPEFTNLKVYHDIKDITARKEIIENAELLDQIAKILTIYQSSEDIQEELTNL

NSELTQEEIEQISNLKGYIGTHNLSLKAINLILDELWHINDNQIAIFNRLKLVPKKVDLSQQKEIPTILVDDFI
```

-continued

```
LSPVVKRSFIQSIKVINAIIKKYGLPNDIIIELAREKNSKDAQKMINEMQKRNRQTNERIEEIIRTIGKENAKY

LIEKIKLHDMQEGKCLYSLEAIPLEDLLNNPFNYEVDHIIPRSVSFDNSFNNKVLVKQEENSKKGNRIPFQYLS

SSDSKISYETFKKHILNLAKGKGRISKTKKEYLLEERDINRFSVQKDFINRNLVDTRYATRGLMNLLRSYFRVN

NLDVKVKSINGGFTSFLRRKWKFKKERNKGYKHHAEDALIIANADFIFKEWKKLDKAKKVMENQMFEEKQAESM

PEIETEQEYKEIFITPHQIKHIKDFKDYKYSHRVDKKPNRELINDTLYSTRKDDKGNTLIVNNLNGLYDKDNDK

LKKLINKSPEKLLMYHHDPQTYQKLKLIMEQYGDEKNPLYKYYEEIGNYLIKYSKKDNGPVIKKIKYYGNKLNA

HLDITDDYPNSRNKVVKLSLKPYREDVYLDNGVYKEVTVKNLDVIKKENYYEVNSKCYEEAKKLKKISNQAEFI

ASFYNNDLIKINGELYRVIGVNNDLLNRIEVNMIDITYREYLENMNDKRPPRIIKTIASKTQSIKKYSTDILGN

LYEVKSKKHPQIIKKG
```

Residue N579 of SEQ ID NO: 266, which is underlined and in bold, may be mutated (e.g., to a A579) to yield a SaCas9 nickase.

Exemplary SaCas9n sequence (SEQ ID NO: 267)

```
KRNYILGLDIGITSVGYGIIDYETRDVIDAGVRLFKEANVENNEGRRSKRGARRLKRRRHRIQRVKKLLFDYN

LLTDHSELSGINPYEARVKGLSQKLSEEEFSAALLHLAKRRGVHNVNEVEEDIGNELSTKEQISRNSKALEEKY

VAELQLERLKKDGEVRGSINRFKISDYVKEAKQLLKVQKAYHQLDQSFIDTYIDLLETRRTYYEGPGEGSPFGW

KDIKEWYEMLMGHCTYFPEELRSVKYAYNADLYNALNDLNNLVITRDENEKLEYYEKFQIIENVFKQKKKPTLK

QIAKEILVNEEDIKGYRVTSTGKPEFTNLKVYHDIKDITARKEIIENAELLDQIAKILTIYQSSEDIQEELTNL

NSELTQEEIEQISNLKGYIGTHNLSLKAINLILDELWHINDNQIAIFNRLKLVPKKVDLSQQKEIPTILVDDFI

LSPVVKRSFIQSIKVINAIIKKYGLPNDIIIELAREKNSKDAQKMINEMQKRNRQTNERIEEIIRTIGKENAKY

LIEKIKLHDMQEGKCLYSLEAIPLEDLLNNPFNYEVDHIIPRSVSFDNSFNNKVLVKQEEASKKGNRIPFQYLS

SSDSKISYETFKKHILNLAKGKGRISKTKKEYLLEERDINRFSVQKDFINRNLVDTRYATRGLMNLLRSYFRVN

NLDVKVKSINGGFTSFLRRKWKFKKERNKGYKHHAEDALIIANADFIFKEWKKLDKAKKVMENQMFEEKQAESM

PEIETEQEYKEIFITPHQIKHIKDFKDYKYSHRVDKKPNRELINDTLYSTRKDDKGNTLIVNNLNGLYDKDNDK

LKKLINKSPEKLLMYHHDPQTYQKLKLIMEQYGDEKNPLYKYYEEIGNYLIKYSKKDNGPVIKKIKYYGNKLNA

HLDITDDYPNSRNKVVKLSLKPYREDVYLDNGVYKEVTVKNLDVIKKENYYEVNSKCYEEAKKLKKISNQAEFI

ASFYNNDLIKINGELYRVIGVNNDLLNRIEVNMIDITYREYLENMNDKRPPRIIKTIASKTQSIKKYSTDILGN

LYEVKSKKHPQIIKKG.
```

Residue A579 of SEQ ID NO: 267, which can be mutated from N579 of SEQ ID NO: 266 to yield a SaCas9 nickase, is underlined and in bold.

Exemplary SaKKH Cas9

(SEQ ID NO: 264)

```
KRNYILGLDIGITSVGYGIIDYETRDVIDAGVRLFKEANVENNEGRRSKRGARRLKRRRHRIQRVKKLLFDYN

LLTDHSELSGINPYEARVKGLSQKLSEEEFSAALLHLAKRRGVHNVNEVEEDIGNELSTKEQISRNSKALEEKY

VAELQLERLKKDGEVRGSINRFKISDYVKEAKQLLKVQKAYHQLDQSFIDTYIDLLETRRTYYEGPGEGSPFGW

KDIKEWYEMLMGHCTYFPEELRSVKYAYNADLYNALNDLNNLVITRDENEKLEYYEKFQIIENVFKQKKKPTLK

QIAKEILVNEEDIKGYRVTSTGKPEFTNLKVYHDIKDITARKEIIENAELLDQIAKILTIYQSSEDIQEELTNL

NSELTQEEIEQISNLKGYIGTHNLSLKAINLILDELWHINDNQIAIFNRLKLVPKKVDLSQQKEIPTILVDDFI

LSPVVKRSFIQSIKVINAIIKKYGLPNDIIIELAREKNSKDAQKMINEMQKRNRQTNERIEEIIRTIGKENAKY

LIEKIKLHDMQEGKCLYSLEAIPLEDLLNNPFNYEVDHIIPRSVSFDNSFNNKVLVKQEEASKKGNRIPFQYLS

SSDSKISYETFKKHILNLAKGKGRISKTKKEYLLEERDINRFSVQKDFINRNLVDTRYATRGLMNLLRSYFRVN

NLDVKVKSINGGFTSFLRRKWKFKKERNKGYKHHAEDALIIANADFIFKEWKKLDKAKKVMENQMFEEKQAESM
```

-continued

```
PEIETEQEYKEIFITPHQIKHIKDFKDYKYSHRVDKKPNRKLINDTLYSTRKDDKGNTLIVNNLNGLYDKDNDK

LKKLINKSPEKLLMYHHDPQTYQKLKLIMEQYGDEKNPLYKYYEEIGNYLIKYSKKDNGPVIKKIKYYGNKLNA

HLDITDDYPNSRNKVVKLSLKPYREDVYLDNGVYKEVTVKNLDVIKKENYYEVNSKCYEEAKKLKKISNQAEFI

ASFY*K*NDLIKINGELYRVIGVNNDLLNRIEVNMIDITYREYLENMNDKRPP*HI*IKTIASKTQSIKKYSTDILGN

LYEVKSKKHPQIIKKG
```

Residue A579 of SEQ ID NO: 268, which can be mutated from N579 of SEQ ID NO: 266 to yield a SaCas9 nickase, is underlined and in bold. Residues K781, K967, and H1014 of SEQ ID NO: 268, which can be mutated from E781, N967, and R1014 of SEQ ID NO: 266 to yield a SaKKH Cas9 are underlined and in italics.

napDNAbp Complexes with Guide RNAs

Some aspects of this disclosure provide complexes comprising any of the nucleic acid programmable DNA binding proteins (napDNAbps) provided herein, and a guide RNA bound to the napDNAbp. In some embodiments, the napDNAbp comprises a Cas9 domain ((e.g., a dCas9 domain, a nuclease active Cas9 domain, or a Cas9 nickase). In some embodiments, this disclosure provide complexes comprising any of the Cas9 domains provided herein, and a guide RNA (gRNA or sgRNA) bound to the Cas9 domain.

Some aspects of this disclosure provide complexes comprising any of the fusion proteins (e.g., a fusion protein comprising a napDNAbp and a nucleic acid editing domain) provided herein, and a guide RNA bound to the napDNAbp. In some embodiments, the fusion protein comprises a Cas9 domain (e.g., a dCas9, a nuclease active Cas9, or a Cas9 nickase), and a guide RNA bound to the Cas9 domain of the fusion protein.

In some embodiments, the guide RNA is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the guide RNA comprises a spacer sequence comprising the nucleic acid sequence of any one of SEQ ID NOs: 600-608 (see Table 5). In some embodiments, the target sequence is a DNA sequence.

In some embodiments, the target sequence is a sequence present in a recording plasmid provided herein. In some embodiments, the target sequence is present in a reporter gene. In some embodiments, the reporter gene is EGFP. In some embodiments, the EGFP gene comprises the nucleic acid sequence CCACCGGCAAGCTGCCCGTGCCC (SEQ ID NO: 620). In some embodiments, the EGFP gene comprises the nucleic acid sequence CCTGAGGCCAAGCTGCCCGTGCCC (SEQ ID NO: 621). In some embodiments the target sequence comprises the amino acid sequence CCACCGGCAAGCTGCCCATGCCC (SEQ ID NO: 622). In some embodiments the target sequence comprises the amino acid sequence ACCAGGGCTCCCACCCGGT (SEQ ID NO: 623). In some embodiments the target sequence comprises the amino acid sequence CATCCAGTCCCACCAGGGCTCCCACCCGGTCCC (SEQ ID NO: 624). In some embodiments the target sequence comprises the amino acid sequence CATCCAGTCCCACCAAAACT (SEQ ID NO: 625). In some embodiments the target sequence comprises the amino acid sequence CATCCAGTCCCACCAAAACTCCC (SEQ ID NO: 626). In some embodiments, the target sequence is a sequence present in a gene located in a safe harbor locus. In some embodiments, the target sequence is a sequence in the genome of a prokaryote (e.g., a prokaryotic (e.g., E. coli) cell). In some embodiments, the target sequence is a sequence in the genome of a eukaryote (e.g., in a eukaryotic cell). In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide RNA is complementary to a sequence associated with a disease or disorder. In some embodiments, the target sequence is complementary to a sgRNA sequence provided herein, for example, a sgRNA sequence comprising a nucleic acid sequence shown in Table 5 (SEQ ID NOs: 600-608).

Nucleic Acid Editing Domains

Any of the nucleic acid programmable DNA binding proteins (e.g, Cas9 domains (e.g., a nuclease active Cas9 domain, a nuclease-inactive dCas9 domain, or a Cas9 nickase domain) disclosed herein may be fused to a second protein, thus providing fusion proteins that comprise a napDNAbp as provided herein and a second protein, or a "fusion partner." Without wishing to be bound by any particular theory, fusion proteins comprising a nucleic acid editing domain are useful inter alia for targeted editing, referred to herein as "base editing," of nucleic acid sequences in vitro and in vivo.

In some embodiments, the second protein in the fusion protein (i.e., the fusion partner) comprises a nucleic acid editing domain. Such a nucleic acid editing domain may be, without limitation, a nuclease, a nickase, a recombinase, a deaminase, a methyltransferase, a methylase, an acetylase, or an acetyltransferase. Non-limiting exemplary nucleic acid editing domains that may be used in accordance with this disclosure include cytidine deaminases and adenosine deaminases. In some embodiments, the nucleic acid editing domain is a deaminase domain. In some embodiments, the nucleic acid editing domain is a nuclease domain. In some embodiments, the nucleic acid editing domain is a nickase domain. In some embodiments, the nucleic acid editing domain is a recombinase domain. In some embodiments, the nucleic acid editing domain is a methyltransferase domain. In some embodiments, the nucleic acid editing domain is a methylase domain. In some embodiments, the nucleic acid editing domain is an acetylase domain. In some embodiments, the nucleic acid editing domain is an acetyltransferase domain.

In some embodiments, the deaminase domain is a cytidine deaminase domain. A cytidine deaminase domain may also be referred to interchangeably as a cytosine deaminase domain. In some embodiments, the cytidine deaminase catalyzes the hydrolytic deamination of cytidine (C) or deoxycytidine (dC) to uridine (U) or deoxyuridine (dU), respectively. In some embodiments, the cytidine deaminase domain catalyzes the hydrolytic deamination of cytosine (C) to uracil (U). In some embodiments, the cytidine deaminase catalyzes the hydrolytic deamination of cytidine or cytosine in deoxyribonucleic acid (DNA). Without wishing to be bound by any particular theory, fusion proteins comprising a cytidine deaminase are useful inter alia for targeted editing, referred to herein as "base editing," of nucleic acid sequences in vitro and in vivo.

One exemplary suitable type of cytidine deaminase is a cytidine deaminase, for example, of the APOBEC family. The apolipoprotein B mRNA-editing complex (APOBEC) family of cytidine deaminase enzymes encompasses eleven proteins that serve to initiate mutagenesis in a controlled and beneficial manner (see, e.g., Conticello S G. The AID/APOBEC family of nucleic acid mutators. *Genome Biol.* 2008; 9(6):229). One family member, activation-induced cytidine deaminase (AID), is responsible for the maturation of antibodies by converting cytosines in ssDNA to uracils in a transcription-dependent, strand-biased fashion (see, e.g., Reynaud C A, et al. What role for AID: mutator, or assembler of the immunoglobulin mutasome? *Nat Immunol.* 2003; 4(7):631-638). The apolipoprotein B editing complex 3 (APOBEC3) enzyme provides protection to human cells against a certain HIV-1 strain via the deamination of cytosines in reverse-transcribed viral ssDNA (see, e.g., Bhagwat A S. DNA-cytosine deaminases: from antibody maturation to antiviral defense. *DNA Repair (Amst).* 2004; 3(1):85-89). These proteins all require a $Zn^{2+}$-coordinating motif (His-X-Glu-$X_{23-26}$-Pro-Cys-$X_{2-4}$-Cys; SEQ ID NO: 800) and bound water molecule for catalytic activity. The Glu residue acts to activate the water molecule to a zinc hydroxide for nucleophilic attack in the deamination reaction. Each family member preferentially deaminates at its own particular "hotspot", ranging from WRC (W is A or T, R is A or G) for hAID, to TTC for hAPOBEC3F (see, e.g., Navaratnam N and Sarwar R. An overview of cytidine deaminases. *Int J Hematol.* 2006; 83(3): 195-200). A recent crystal structure of the catalytic domain of APOBEC3G revealed a secondary structure comprised of a five-stranded ß-sheet core flanked by six α-helices, which is believed to be conserved across the entire family (see, e.g., Holden L G, et al. Crystal structure of the anti-viral APOBEC3G catalytic domain and functional implications. *Nature.* 2008; 456(7218):121-4). The active center loops have been shown to be responsible for both ssDNA binding and in determining "hotspot" identity (see, e.g., Chelico L, et al. Biochemical basis of immunological and retroviral responses to DNA-targeted cytosine deamination by activation-induced cytidine deaminase and APOBEC3G. *J Biol Chem.* 2009; 284 (41). 27761-5). Overexpression of these enzymes has been linked to genomic instability and cancer, thus highlighting the importance of sequence-specific targeting (see, e.g., Pham P, et al. Reward versus risk: DNA cytidine deaminases triggering immunity and disease. *Biochemistry.* 2005; 44(8):2703-15).

Some aspects of this disclosure relate to the recognition that the activity of cytidine deaminase enzymes such as APOBEC enzymes can be directed to a specific site in genomic DNA. Without wishing to be bound by any particular theory, advantages of using a nucleic acid programmable binding protein (e.g., a Cas9 domain) as a recognition agent include (1) the sequence specificity of nucleic acid programmable binding protein (e.g., a Cas9 domain) can be easily altered by simply changing the sgRNA sequence; and (2) the nucleic acid programmable binding protein (e.g., a Cas9 domain) may bind to its target sequence by denaturing the dsDNA, resulting in a stretch of DNA that is single-stranded and therefore a viable substrate for the deaminase. It should be understood that other catalytic domains of napDNAbps, or catalytic domains from other nucleic acid editing proteins, can also be used to generate fusion proteins with Cas9, and that the disclosure is not limited in this regard.

In view of the results provided herein regarding the nucleotides that can be targeted by Cas9:deaminase fusion proteins, a person of ordinary skill in the art will be able to design suitable guide RNAs to target the fusion proteins to a target sequence that comprises a nucleotide to be deaminated.

In some embodiments, the cytidine deaminase is an apolipoprotein B mRNA-editing complex (APOBEC) family deaminase. In some embodiments, the cytidine deaminase is an APOBEC1 deaminase. In some embodiments, the cytidine deaminase is an APOBEC2 deaminase. In some embodiments, the cytidine deaminase is an APOBEC3 deaminase. In some embodiments, the cytidine deaminase is an APOBEC3A deaminase. In some embodiments, the cytidine deaminase is an APOBEC3B deaminase. In some embodiments, the cytidine deaminase is an APOBEC3C deaminase. In some embodiments, the cytidine deaminase is an APOBEC3D deaminase. In some embodiments, the cytidine deaminase is an APOBEC3E deaminase. In some embodiments, the cytidine deaminase is an APOBEC3F deaminase. In some embodiments, the cytidine deaminase is an APOBEC3G deaminase. In some embodiments, the cytidine deaminase is an APOBEC3H deaminase. In some embodiments, the cytidine deaminase is an APOBEC4 deaminase. In some embodiments, the cytidine deaminase is an activation-induced deaminase (AID). In some embodiments, the cytidine deaminase is a vertebrate cytidine deaminase. In some embodiments, the cytidine deaminase is an invertebrate cytidine deaminase. In some embodiments, the cytidine deaminase is a human, chimpanzee, gorilla, monkey, cow, dog, rat, or mouse deaminase. In some embodiments, the cytidine deaminase is a human cytidine deaminase. In some embodiments, the cytidine deaminase is a rat cytidine deaminase, e.g., rAPOBEC1. In some embodiments, the cytidine deaminase is a *Petromyzon marinus* cytidine deaminase 1 (pmCDA1). In some embodiments, the cytidine deaminase is a human APOBEC3G (SEQ ID NO: 359). In some embodiments, the cytidine deaminase is a fragment of the human APOBEC3G (SEQ ID NO: 388). In some embodiments, the deaminase is a human APOBEC3G variant comprising a D316R and D317R mutation (SEQ ID NO: 387). In some embodiments, the deaminase is a fragment of the human APOBEC3G and comprising mutations corresponding to the D316R and D317R mutations in SEQ ID NO: 359 (SEQ ID NO: 389).

In some embodiments, the nucleic acid editing domain is at least 80%, at least 85%, at least 90%, at least 92%, at least 95%, at least 96%, at least 97%, at least 98%, at least 99%, or at least 99.5% identical to the deaminase domain of any one of SEQ ID NOs: 350-389. In some embodiments, the nucleic acid editing domain comprises the amino acid sequence of any one of SEQ ID NOs: 350-389.

Some exemplary suitable nucleic-acid editing domains, e.g., cytidine deaminases and cytidine deaminase domains, that can be fused to napDNAbps (e.g., Cas9 domains) according to aspects of this disclosure are provided below. It should be understood that, in some embodiments, the active domain of the respective sequence can be used, e.g., the domain without a localizing signal (nuclear localization sequence, without nuclear export signal, cytoplasmic localizing signal).

Human AID:
(SEQ ID NO: 350)
MDSLLMNRRKFLYQFKNVRWAKGRRETYLCYVVKRRDSATSFSLDFGYLRNKNGCHVELLFLRYISDWDLDPGR

CYRVTWFTSWSPCYDCARHVADFLRGNPNLSLRIFTARLYFCEDRKAEPEGLRRLHRAGVQIAIMTFKDYFYCW

NTFVENHERTFKAWEGLHENSVRLSRQLRRILLPLYEVDDLRDAFRTLGL (underline: nuclear localization sequence; double underline: nuclear export signal)

Mouse AID:
(SEQ ID NO: 351)
MDSLLMKQKKFLYHFKNVRWAKGRHETYLCYVVKRRDSATSCSLDFGHLRNKSGCHVELLFLRYISDWDLDPGR

CYRVTWFTSWSPCYDCARHVAEFLRWNPNLSLRIFTARLYFCEDRKAEPEGLRRLHRAGVQIGIMTFKDYFYCW

NTFVENRERTFKAWEGLHENSVRLTRQLRRILLPLYEVDDLRDAFRMLGF (underline: nuclear localization sequence; double underline: nuclear export signal)

Dog AID:
(SEQ ID NO: 352)
MDSLLMKQRKFLYHFKNVRWAKGRHETYLCYVVKRRDSATSFSLDFGHLRNKSGCHVELLFLRYISDWDLDPGR

CYRVTWFTSWSPCYDCARHVADFLRGYPNLSLRIFAARLYFCEDRKAEPEGLRRLHRAGVQIAIMTFKDYFYCW

NTFVENREKTFKAWEGLHENSVRLSRQLRRILLPLYEVDDLRDAFRTLGL (underline: nuclear localization sequence; double underline: nuclear export signal)

Bovine AID:
(SEQ ID NO: 353)
MDSLLKKQRQFLYQFKNVRWAKGRHETYLCYVVKRRDSPTSFSLDFGHLRNKAGCHVELLFLRYISDWDLDPGR

CYRVTWFTSWSPCYDCARHVADFLRGYPNLSLRIFTARLYFCDKERKAEPEGLRRLHRAGVQIAIMTFKDYFYC

WNTFVENHERTFKAWEGLHENSVRLSRQLRRILLPLYEVDDLRDAFRTLGL (underline: nuclear localization sequence; double underline: nuclear export signal)

Rat AID:
(SEQ ID NO: 374)
MAVGSKPKAALVGPHWERERIWCFLCSTGLGTQQTGQTSRWLRPAATQDPVSPPRSLLMKQRKFLYHFKNVRWA

KGRHETYLCYVVKRRDSATSFSLDFGYLRNKSGCHVELLFLRYISDWDLDPGRCYRVTWFTSWSPCYDCARHVA

DFLRGNPNLSLRIFTARLTGWGALPAGLMSPARPSDYFYCWNTFV*ENHERTFKAWEGLHENSVRLSRRLRRILL*

*PLYEVDDLRDAFRTLGL*

(underline: nuclear localization sequence; double underline: nuclear export signal)

Mouse APOBEC-3:
(SEQ ID NO: 354)
MGPFCLGCSHRKCYSPIRNLISQETFKFHFKNLGYAKGRKDTFLCYEVTRKDCDSPVSLHHGVFKNKDNI*HAEI*

*CFLYWFHDKVLKVLSPREEFKITWYMSWSPCFEC*AEQIVRFLATHHNLSLDIFSSRLYNVQDPETQQNLCRLVQ

EGAQVAAMDLYEFKKCWKKFVDNGGRRFRPWKRLLTNFRYQDSKLQEILRPCYIPVPSSSSSTLSNICLTKGLP

ETRFCVEGRRMDPLSEEEFYSQFYNQRVKHLCYYHRMKPYLCYQLEQFNGQAPLKGCLLSEKGKQ*HAEILFLDK*

*IRSMELSQVTITCYLTWSPCPNC*AWQLAAFKRDRPDLILHIYTSRLYFHWKRPFQKGLCSLWQSGILVDVMDLP

QFTDCWTNFVNPKRPFWPWKGLEIISRRTQRRLRRIKESWGLQDLVNDFGNLQLGPPMS (italic: nucleic acid editing domain)

Rat APOBEC-3:
(SEQ ID NO: 355)
MGPFCLGCSHRKCYSPIRNLISQETFKFHFKNLRYAIDRKDTFLCYEVTRKDCDSPVSLHHGVFKNKDNI*HAEI*

*CFLYWFHDKVLKVLSPREEFKITWYMSWSPCFEC*AEQVLRFLATHHNLSLDIFSSRLYNIRDPENQQNLCRLVQ

EGAQVAAMDLYEFKKCWKKFVDNGGRRFRPWKKLLTNFRYQDSKLQEILRPCYIPVPSSSSSTLSNICLTKGLP

ETRFCVERRRVHLLSEEEFYSQFYNQRVKHLCYYHGVKPYLCYQLEQFNGQAPLKGCLLSEKGKQ*HAEILFLDK*

*IRSMELSQVIITCYLTWSPCPNC*AWQLAAFKRDRPDLILHIYTSRLYFHWKRPFQKGLCSLWQSGILVDVMDLP

QFTDCWTNFVNPKRPFWPWKGLEIISRRTQRRLHRIKESWGLQDLVNDFGNLQLGPPMS (italic: nucleic acid editing domain)

Rhesus macaque APOBEC-3G:

(SEQ ID NO: 356)

<u>MVEPMDPRTFVSNFNNRPILSGLNTVWLCCEVKTKDPSGPPLDAKIFQGKVYSKAKY</u>*HPEMRFLRWFHKWRQLH*

*HDQEYKVTWYVSWSPCTRC*ANSVATFLAKDPKVTLTIFVARLYYFWKPDYQQALRILCQKRGGPHATMKIMNYN

EFQDCWNKFVDGRGKPFKPRNNLPKHYTLLQATLGELLRHLMDPGTFTSNFNNKPWVSGQHETYLCYKVERLHN

DTWVPLNQHRGFLRNQAPNIHGFPKGR*HAELCFLDLIPFWKLDGQQYRVTCFTSWSPCFSC*AQEMAKFISNNEH

VSLCIFAARIYDDQGRYQEGLRALHRDGAKIAMMNYSEFEYCWDTFVDRQGRPFQPWDGLDEHSQALSGRLRAI (italic: nucleic acid editing domain; underline: cytoplasmic localization signal)

Chimpanzee APOBEC-3G:

(SEQ ID NO: 357)

<u>MKPHFRNPVERMYQDTFSDNFYNRPILSHRNTVWLCYEVKTKGPSRPPLDAKIFRGQVYSKLKY</u>*HPEMRFFHWF*

*SKWRKLHRDQEYEVTWYISWSPCTKC*TRDVATFLAEDPKVTLTIFVARLYYFWDPDYQEALRSLCQKRDGPRAT

MKIMNYDEFQHCWSKFVYSQRELFEPWNNLPKYYILLHIMLGEILRHSMDPPTFTSNFNNELWVRGRHETYLCY

EVERLHNDTWVLLNQRRGFLCNQAPHKHGFLEGR*HAELCFLDVIPFWKLDLHQDYRVTCFTSWSPCFSC*AQEMA

KFISNNKHVSLCIFAARIYDDQGRCQEGLRTLAKAGAKISIMTYSEFKHCWDTFVDHQGCPFQPWDGLEEHSQA

LSGRLRAILQNQGN (italic: nucleic acid editing domain; underline: cytoplasmic localization signal)

Green monkey APOBEC-3G:

(SEQ ID NO: 358)

<u>MNPQIRNMVEQMEPDIFVYYFNNRPILSGRNTVWLCYEVKTKDPSGPPLDANIFQGKLYPEAKD</u>*HPEMKFLHWF*

*RKWRQLHRDQEYEVTWYVSWSPCTRC*ANSVATFLAEDPKVTLTIFVARLYYFWKPDYQQALRILCQERGGPHAT

MKIMNYNEFQHCWNEFVDGQGKPFKPRKNLPKHYTLLHATLGELLRHVMDPGTFTSNFNNKPWVSGQRETYLCY

KVERSHNDTWVLLNQHRGFLRNQAPDRHGFPKGR*HAELCFLDLIPFWKLDDQQYRVTCFTSWSPCFSC*AQKMAK

FISNNKHVSLCIFAARIYDDQGRCQEGLRTLHRDGAKIAVMNYSEFEYCWDTFVDRQGRPFQPWDGLDEHSQAL

SGRLRAI (italic: nucleic acid editing domain; underline: cytoplasmic localization signal)

Human APOBEC-3G:

(SEQ ID NO: 359)

<u>MKPHFRNTVERMYRDTFSYNFYNRPILSRRNTVWLCYEVKTKGPSRPPLDAKIFRGQVYSELKY</u>*HPEMRFFHWF*

*SKWRKLHRDQEYEVTWYISWSPCTKC*TRDMATFLAEDPKVTLTIFVARLYYFWDPDYQEALRSLCQKRDGPRAT

MKIMNYDEFQHCWSKFVYSQRELFEPWNNLPKYYILLHIMLGEILRHSMDPPTFTFNFNNEPWVRGRHETYLCY

EVERMHNDTWVLLNQRRGFLCNQAPHKHGFLEGR*HAELCFLDVIPFWKLDLDQDYRVTCFTSWSPCFSC*AQEMA

KFISKNKHVSLCIFTARIYDDQGRCQEGLRTLAEAGAKISIMTYSEFKHCWDTFVDHQGCPFQPWDGLDEHSQD

LSGRLRAILQNQEN (italic: nucleic acid editing domain; underline: cytoplasmic localization signal)

Human APOBEC-3F:

(SEQ ID NO: 360)

MKPHFRNTVERMYRDTFSYNFYNRPILSRRNTVWLCYEVKTKGPSRPRLDAKIFRGQVYSQPEH*HAEMCFLSWF*

*CGNQLPAYKCFQITWFVSWTPCPDC*VAKLAEFLAEHPNVTLTISAARLYYYWERDYRRALCRLSQAGARVKIMD

-continued

DEEFAYCWENFVYSEGQPFMPWYKFDDNYAFLHRTLKEILRNPMEAMYPHIFYFHFKNLRKAYGRNESWLCFTM

EVVKHHSPVSWKRGVFRNQVDPETHC*HAERCFLSWFCDDILSPNTNYEVTWYTSWSPCPEC*AGEVAEFLARHSN

VNLTIFTARLYYFWDTDYQEGLRSLSQEGASVEIMGYKDFKYCWENFVYNDDEPFKPWKGLKYNFLFLDSKLQE

ILE (italic: nucleic acid editing domain)

Human APOBEC-3B:
(SEQ ID NO: 361)
MNPQIRNPMERMYRDTFYDNFENEPILYGRSYTWLCYEVKIKRGRSNLLWDTGVFRGQVYFKPQY*HAEMCFLSW*

*FCGNQLPAYKCFQITWFVSWTPCPDC*VAKLAEFLSEHPNVTLTISAARLYYYWERDYRRALCRLSQAGARVTIM

DYEEFAYCWENFVYNEGQQFMPWYKFDENYAFLHRTLKEILRYLMDPDTFTFNFNNDPLVLRRRQTYLCYEVER

LDNGTWVLMDQHMGFLCNEAKNLLCGFY*GRHAELRFLDLVPSLQLDPAQIYRVTWFISWSPCFSWGC*AGEVRAF

LQENTHVRLRIFAARIYDYDPLYKEALQMLRDAGAQVSIMTYDEFEYCWDTFVYRQGCPFQPWDGLEEHSQALS

GRLRAILQNQGN (italic: nucleic acid editing domain)

Rat APOBEC-3B:
(SEQ ID NO: 378)
MQPQGLGPNAGMGPVCLGCSHRRPYSPIRNPLKKLYQQTFYFHFKNVRYAWGRKNNFLCYEVNGMDCALPVPLR

QGVFRKQGHIHAELCFIYWFHDKVLRVLSPMEEFKVTWYMSWSPCSKCAEQVARFLAAHRNLSLAIFSSRLYYY

LRNPNYQQKLCRLIQEGVHVAAMDLPEFKKCWNKFVDNDGQPFRPWMRLRINFSYDCKLQEIFSRMNLLREDV

FYLQFNNSHRVKPVQNRYYRRKSYLCYQLERANGQEPLKGYLLYKKGEQHVEILFLEKMRSMELSQVRITCYLT

WSPCPNCARQLAAFKKDHPDLILRIYTSRLYFYWRKKFQKGLCTLWRSGIHVDVMDLPQFADCWTNFVNPQRPF

RPWNELEKNSWRIQRRLRRIKESWGL

Bovine APOBEC-3B:
(SEQ ID NO: 379)
DGWEVAFRSGTVLKAGVLGVSMTEGWAGSGHPGQGACVWTPGTRNTMNLLREVLFKQQFGNQPRVPAPYYRRKT

YLCYQLKQRNDLTLDRGCFRNKKQRHAEIRFIDKINSLDLNPSQSYKIICYITWSPCPNCANELVNFITRNNHL

KLEIFASRLYFHWIKSFKMGLQDLQNAGISVAVMTHTEFEDCWEQFVDNQSRPFQPWDKLEQYSASIRRRLQRI

LTAPI

Chimpanzee APOBEC-3B:
(SEQ ID NO: 380)
MNPQIRNPMEWMYQRTFYYNFENEPILYGRSYTWLCYEVKIRRGHSNLLWDTGVFRGQMYSQPEHHAEMCFLSW

FCGNQLSAYKCFQITWFVSWTPCPDCVAKLAKFLAEHPNVTLTISAARLYYYWERDYRRALCRLSQAGARVKIM

DDEEFAYCWENFVYNEGQPFMPWYKFDDNYAFLHRTLKEIIRHLMDPDTFTFNFNNDPLVLRRHQTYLCYEVER

LDNGTWVLMDQHMGFLCNEAKNLLCGFYGRHAELRFLDLVPSLQLDPAQIYRVTWFISWSPCFSWGCAGQVRAF

LQENTHVRLRIFAARIYDYDPLYKEALQMLRDAGAQVSIMTYDEFEYCWDTFVYRQGCPFQPWDGLEEHSQALS

GRLRAILQVRASSLCMVPHRPPPPPQSPGPCLPLCSEPPLGSLLPTGRPAPSLPFLLTASFSFPPPASLPPLPS

LSLSPGHLPVPSFHSLTSCSIQPPCSSRIRETEGWASVSKEGRDLG

Human APOBEC-3C:
(SEQ ID NO: 362)
MNPQIRNPMKAMYPGTFYFQFKNLWEANDRNETWLCFTVEGIKRRSVVSWKTGVFRNQVDSETH*CHAERCFLSW*

*FCDDILSPNTKYQVTWYTSWSPCPDC*AGEVAEFLARHSNVNLTIFTARLYYFQYPCYQEGLRSLSQEGVAVEIM

DYEDFKYCWENFVYNDNEPFKPWKGLKTNFRLLKRRLRESLQ (italic: nucleic acid editing domain)

Gorilla APOBEC3C:
(SEQ ID NO: 375)
MNPQIRNPMKAMYPGTFYFQFKNLWEANDRNETWLCFTVEGIKRRSVVSWKTGVFRNQVDSETH*CHAERCFLSW*

*FCDDILSPNTNYQVTWYTSWSPCPEC*AGEVAEFLARHSNVNLTIFTARLYYFQDTDYQEGLRSLSQEGVAVKIM

DYKDFKYCWENEVYNDDEPFKPWKGLKYNERFLKRRLQEILE (italic: nucleic acid editing domain)

Human APOBEC-3A:
(SEQ ID NO: 363)
MEASPASGPRHLMDPHIFTSNFNNGIGRHKTYLCYEVERLDNGTSVKMDQHRGFLHNQAKNLLCGFYGR*HAELR*

*FLDLVPSLQLDPAQIYRVTWFISWSPCFSWGC*AGEVRAFLQENTHVRLRIFAARIYDYDPLYKEALQMLRDAGA

QVSIMTYDEFKHCWDTFVDHQGCPFQPWDGLDEHSQALSGRLRAILQNQGN (italic: nucleic acid editing domain)

Rhesus macaque APOBEC-3A:
(SEQ ID NO: 376)
MDGSPASRPRHLMDPNTFTFNENNDLSVRGRHQTYLCYEVERLDNGTWVPMDERRGFLCNKAKNVPCGDYGC*HV*

*ELRFLCEVPSWQLDPAQTYRVTWFISWSPC*FRRGCAGQVRVFLQENKHVRLRIFAARIYDYDPLYQEALRTLRD

AGAQVSIMTYEEFKHCWDTFVDRQGRPFQPWDGLDEHSQALSGRLRAILQNQGN (italic: nucleic acid editing domain)

Bovine APOBEC-3A:
(SEQ ID NO: 377)
MDEYTFTENFNNQGWPSKTYLCYEMERLDGDATIPLDEYKGFVRNKGLDQPEKPC*HAELYFLGKIHSWNLDRNQ*

*HYRLTCFISWSPC*YDCAQKLTTFLKENHHISLHILASRIYTHNRFGCHQSGLCELQAAGARITIMTFEDFKHCW

ETFVDHKGKPFQPWEGLNVKSQALCTELQAILKTQQN (italic: nucleic acid editing domain)

Human APOBEC-3H:
(SEQ ID NO: 364)
MALLTAETERLQFNNKRRLRRPYYPRKALLCYQLTPQNGSTPIRGYFENKKKC*HAEICFINEIKSMGLDETQCY*

*QVTCYLTWSPCSS*CAWELVDFIKAHDHLNLGIFASRLYYHWCKPQQKGLRLLCGSQVPVEVMGFPKFADCWENF

VDHEKPLSFNPYKMLEELDKNSRAIKRRLERIKIPGVRAQGRYMDILCDAEV (italic: nucleic acid editing domain)

Rhesus macaque APOBEC-3H:
(SEQ ID NO: 381)
MALLTAKTFSLQFNNKRRVNKPYYPRKALLCYQLTPQNGSTPTRGHLKNKKKDHAEIRFINKIKSMGLDETQCY

QVTCYLTWSPCPSCAGELVDFIKAHRHLNLRIFASRLYYHWRPNYQEGLLLLCGSQVPVEVMGLPEFTDCWENF

VDHKEPPSFNPSEKLEELDKNSQAIKRRLERIKSRSVDVLENGLRSLQLGPVTPSSSIRNSR

Human APOBEC-3D:
(SEQ ID NO: 365)
MNPQIRNPMERMYRDTFYDNFENEPILYGRSYTWLCYEVKIKRGRSNLLWDTGVFRGPVLPKRQSNHRQEVYFR

FEN*HAEMCFLSWFCGNRLPANRREQITWFVSWNPCLPC*VVKVTKFLAEHPNVTLTISAARLYYYRDRDWRWVLL

RLHKAGARVKIMDYEDFAYCWENFVCNEGQPFMPWYKEDDNYASLHRTLKEILRNPMEAMYPHIFYFHFKNLLK

ACGRNESWLCFTMEVTKHHSAVERKRGVERNQVDPETHC*HAERCFLSWFCDDILSPNTNYEVTWYTSWSPCPEC*

AGEVAEFLARHSNVNLTIFTARLCYFWDTDYQEGLCSLSQEGASVKIMGYKDEVSCWKNEVYSDDEPFKPWKGL

QTNERLLKRRLREILQ (italic: nucleic acid editing domain)

Human APOBEC-1:
(SEQ ID NO: 366)
MTSEKGPSTGDPTLRRRIEPWEEDVEYDPRELRKEACLLYEIKWGMSRKIWRSSGKNTINHVEVNFIKKFTSER

DFHPSMSCSITWFLSWSPCWECSQAIREELSRHPGVTLVIYVARLFWHMDQQNRQGLRDLVNSGVTIQIMRASE

-continued

YYHCWRNFVNYPPGDEAHWPQYPPLWMMLYALELHCIILSLPPCLKISRRWQNHLTFFRLHLQNCHYQTIPPHI

LLATGLIHPSVAWR

Mouse APOBEC-1:

(SEQ ID NO: 367)

MSSETGPVAVDPTLRRRIEPHEFEVFFDPRELRKETCLLYEINWGGRHSVWRHTSQNTSNHVEVNFLEKFTTER

YFRPNTRCSITWFLSWSPCGECSRAITEFLSRHPYVTLFIYIARLYHHTDQRNRQGLRDLISSGVTIQIMTEQE

YCYCWRNFVNYPPSNEAYWPRYPHLWVKLYVLELYCIILGLPPCLKILRRKQPQLTFFTITLQTCHYQRIPPHL

LWATGLK

Rat APOBEC-1:

(SEQ ID NO: 368)

MSSETGPVAVDPTLRRRIEPHEFEVFFDPRELRKETCLLYEINWGGRHSIWRHTSQNTNKHVEVNFIEKFTTER

YFCPNTRCSITWFLSWSPCGECSRAITEFLSRYPHVTLFIYIARLYHHADPRNRQGLRDLISSGVTIQIMTEQE

SGYCWRNFVNYSPSNEAHWPRYPHLWVRLYVLELYCIILGLPPCLNILRRKQPQLTFFTIALQSCHYQRLPPHI

LWATGLK

Human APOBEC-2:

(SEQ ID NO: 382)

MAQKEEAAVATEAASQNGEDLENLDDPEKLKELIELPPFEIVTGERLPANFFKFQFRNVE

YSSGRNKTFLCYVVEAQGKGGQVQASRGYLEDEHAAAHAEEAFFNTILPAFDDPALRYNVIWYVSSSPCAACADR

IIKILSKTKNLRLLILVGRLFMWEEPEIQAALKKLKEAGCKLRIMKPQDFEYVWQNFVEQEEGESKAFQPWEDI

QENFLYYEEKLADILK

Mouse APOBEC-2:

(SEQ ID NO: 383)

MAQKEEAAEAAAPASQNGDDLENLEDPEKLKELIDLPPFEIVTGVRLPVNFFKFQFRNVEYSSGRNKTFLCYVV

EVQSKGGQAQATQGYLEDEHAGAHAEEAFFNTILPAFDPALKYNVTWYVSSSPCAACADRILKTLSKTKNLRLL

ILVSRLFMWEEPEVQAALKKLKEAGCKLRIMKPQDFEYIWQNFVEQEEGESKAFEPWEDIQENFLYYEEKLADI

LK

Rat APOBEC-2:

(SEQ ID NO: 384)

MAQKEEAAEAAAPASQNGDDLENLEDPEKLKELIDLPPFEIVTGVRLPVNFFKFQFRNVEYSSGRNKTFLCYVV

EAQSKGGQVQATQGYLEDEHAGAHAEEAFFNTILPAFDPALKYNVTWYVSSSPCAACADRILKTLSKTKNLRLL

ILVSRLFMWEEPEVQAALKKLKEAGCKLRIMKPQDFEYLWQNFVEQEEGESKAFEPWEDIQENFLYYEEKLADI

LK

Bovine APOBEC-2:

(SEQ ID NO: 385)

MAQKEEAAAAAEPASQNGEEVENLEDPEKLKELIELPPFEIVTGERLPAHYFKFQFRNVE

YSSGRNKTFLCYVVEAQSKGGQVQASRGYLEDEHATNHAEEAFFNSIMPTFDPALRYMVIWYVSSSPCAACADR

IVKILNKTKNLRLLILVGRLFMWEEPEIQAALRKLKEAGCRLRIMKPQDFEYIWQNFVEQEEGESKAFEPWEDI

QENFLYYEEKLADILK

Petromyzon marinus CDA1 (pmCDA1):

(SEQ ID NO: 386)

MTDAEYVRIHEKLDIYTFKKQFFNNKKSVSHRCYVLFELKRRGERRACFWGYAVNKPQSGTERGIHAEIFSIRK

VEEYLRDNPGQFTINWYSSWSPCADCAEKILEWYNQELRGNGHTLKIWACKLYYEKNARNQIGLWNLRDNGVGL

NVMVSEHYQCCRKIFIQSSHNQLNENRWLEKTLKRAEKRRSELSIMIQVKILHTTKSPAV

Human APOBEC3G D316R D317R:

(SEQ ID NO: 387)

MKPHFRNTVERMYRDTFSYNFYNRPILSRRNTVWLCYEVKTKGPSRPPLDAKIFRGQVYSELKYHPEMRFFHWF

SKWRKLHRDQEYEVTWYISWSPCTKCTRDMATFLAEDPKVTLTIFVARLYYFWDPDYQEALRSLCQKRDGPRAT

MKIMNYDEFQHCWSKFVYSQRELFEPWNNLPKYYILLHIMLGEILRHSMDPPTFTFNENNEPWVRGRHETYLCY

EVERMHNDTWVLLNQRRGELCNQAPHKHGELEGRHAELCFLDVIPFWKLDLDQDYRVTCFTSWSPCFSCAQEMA

-continued

```
KFISKNKHVSLCIFTARIYRRQGRCQEGLRTLAEAGAKISIMTYSEFKHCWDTFVDHQGCPFQPWDGLDEHSQD

LSGRLRAILQNQEN

Human APOBEC3G chain A:
                                                              (SEQ ID NO: 388)
MDPPTFTFNFNNEPWVRGRHETYLCYEVERMHNDTWVLLNQRRGFLCNQAPHKHGFLEGRHAELCFLDVIPFWK

LDLDQDYRVTCFTSWSPCFSCAQEMAKFISKNKHVSLCIFTARIYDDQGRCQEGLRTLAEAGAKISIMTYSEFK

HCWDTFVDHQGCPFQPWDGLDEHSQDLSGRLRAILQ

Human APOBEC3G chain A D120R_D121R:
                                                              (SEQ ID NO: 389)
MDPPTFTFNFNNEPWVRGRHETYLCYEVERMHNDTWVLLNQRRGFLCNQAPHKHGFLEGRHAELCFLDVIPFW

KLDLDQDYRVTCFTSWSPCFSCAQEMAKFISKNKHVSLCIFTARIYRRQGRCQEGLRTLAEAGAKISIMTYSE

FKHCWDTFVDHQGCPFQPWDGLDEHSQDLSGRLRAILQ
```

In some embodiments, the deaminase domain is an adenosine deaminase domain. In some embodiments, the adenosine deaminase catalyzes the hydrolytic deamination of adenosine (A) or deoxyadenosine (dA) to inosine (I) or deoxyinosine (dI), respectively. In some embodiments, the adenosine deaminase catalyzes the hydrolytic deamination of adenine or adenosine in deoxyribonucleic acid (DNA). For example, the adenosine may be converted to an inosine residue, which typically base pairs with a cytosine residue. Without wishing to be bound by any particular theory, fusion proteins comprising an adenosine deaminase are useful inter alia for targeted editing, referred to herein as "base editing," of nucleic acid sequences in vitro and in vivo. The adenosine deaminase may be derived from any suitable organism (e.g., *E. coli*). In some embodiments, the adenine deaminase is a naturally-occurring adenosine deaminase that includes one or more mutations (i.e., a recombinant adenosine deaminase) corresponding to any of the mutations provided herein (e.g., mutations in ecTadA). One of ordinary skill in the art will be able to identify the corresponding residue in any homologous protein and in the respective encoding nucleic acid by methods well known in the art, e.g., by sequence alignment and determination of homologous residues. Accordingly, one of ordinary skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

In some embodiments, the adenosine deaminase comprises the amino acid sequence of any one of SEQ ID NOs: 400-458. In some embodiments, the adenosine deaminase consists of the amino acid sequence of any one of SEQ ID NOs: 400-458. In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 400-458. Additional adenosine deaminase domains are provided and described in Gaudelli N M, et al. (2017) Programmable base editing of A·T to G·C in genomic DNA without DNA cleavage, *Nature*, 551(23); 464-471; the entire contents of which is incorporated herein by reference. It should be appreciated that adenosine deaminases provided herein may include one or more mutations (e.g., any of the mutations provided herein), or may not include any mutations (i.e., a wild-type adenosine deaminase). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 400-458 or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NOs: 400-458, or any of the adenosine deaminases provided herein.

It should be appreciated that the adenosine deaminase (e.g., a first or second adenosine deaminase) may comprise one or more of the mutations provided in any of the adenosine deaminases (e.g., ecTadA adenosine deaminases) shown in Example 2. In some embodiments, the adenosine deaminase comprises the combination of mutations of any of the adenosine deaminases (e.g., ecTadA adenosine deaminases) shown in Example 2. For example, the adenosine deaminase may comprise the mutations W23R, H36L, P48A, R51L, L84F, A106V, D108N, H123Y, S146C, D147Y, R152P, E155V, I156F, and K157N (relative to SEQ ID NO: 400), which is also referred to as ABE7.10. In some embodiments, the adenosine deaminase may comprise the mutations H36L, R51L, L84F, A106V, D108N, H123Y, S146C, D147Y, E155V, I156F, and K157N (relative to SEQ ID NO: 400). In some embodiments, the adenosine deaminase comprises any of the following combination of mutations relative to SEQ ID NO: 400, where each mutation of a combination is separated by a "_" and each combination of mutations is between parentheses: (A106V_D108N), (R107C_D108N), (H8Y_D108N_S127S_D147Y_Q154H), (H8Y_R24W_D108N_N127S_D147Y_E155V), (D108N_D147Y_E155V), (H8Y_D108N_S127S), (H8Y_D108N_N127S_D147Y_Q154H),
(A106V_D108N_D147Y_E155V),
(D108Q_D147Y_E155V), (D108M_D147Y_E155V),
(D108L_D147Y_E155V), (D108K_D147Y_E155V),
(D108I_D147Y_E155V), (D108F_D147Y_E155V),
(A106V_D108N_D147Y),
(A106V_D108M_D147Y_E155V),
(E59A_A106V_D108N_D147Y_E155V), (E59A cat dead_A106V_D108N_D147Y_E155V),
(L84F_A106V_D108N_H123Y_D147Y_E155V_I156Y),
(L84F_A106V_D108N_H123Y_D147Y_E155V_I156F),
(D103A_D014N), (G22P_D103A_D104N),
(G22P_D103A_D104N_S138A),
(D103A_D104N_S138A),
(R26G_L84F_A106V_R107H_D108N_H123Y_A142N_A143D_D147Y_E155V_I156F),
(E25G_R26G_L84F_A106V_R107H_D108N_H123Y_A142N_A143D_D147Y_E155V I156F),
(E25D_R26G_L84F_A106V_R107K_D108N_H123Y_A142N_A143G_D147Y_E155V_I156F),
(R26Q_L84F_A106V_D108N_H123Y_A142N_D147Y_E155V_I156F),
(E25M_R26G_L84F_A106V_R107P_D108N_H123Y_A142N_A143D_D147Y_E155V_I156F),
(R26C_L84F_A106V_R107H_D108N_H123Y_A142N_D147Y_E155V_I156F),
(L84F_A106V_D108N_H123Y_A142N_A143L_D147Y_E155V_I156F),
(R26G_L84F_A106V_D108N_H123Y_A142N_D147Y_E155V_I156F),
(E25A_R26G_L84F_A106V_R107N_D108N_H123Y_A142N_A143E_D147Y_E155V_I156F),
(R26G_L84F_A106V_R107H_D108N_H123Y_A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_A143G_D147Y_E155V),
(R26G_A106V_D108N_R107H_A142N_A143D_D147Y_E155V),
(E25D_R26G_A106V_D108N_A142N_D147Y_E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_S146C_D147Y_E155V_I156F_K157N),
(H36L_P48S_R51L_L84F_A106V_D108N_H123Y_S146C_D147Y_E155V_I156F_K157N),
(H36L_P48S_R51L_L84F_A106V_D108N_H123Y_A142N_S146C_D147Y_E155V_I156F_K157N),
(W23L_H36L_P48A_R51L_L84F_A106V_D108N_H123Y_A142N_S146C_D147Y_E155V_I156F_K157N),
(W23L_H36L_P48A_R51L_L84F_A106V_D108N_H123Y_A142N_S146C_D147Y_R152P E155V_I156F_K157N),
(N37T_P48T_M70L_L84F_A106V_D108N_H123Y_D147Y_I49V_E155V_I156F),
(N37S_L84F_A106V_D108N_H123Y_D147Y_E155V_I156F_K16IT),
(H36L_L84F_A106V_D108N_H123Y_D147Y_Q154H_E155V_I156F),
(N72S_L84F_A106V_D108N_H123Y_S146R_D147Y_E155V_I156F),
(H36L_P48L_L84F_A106V_D108N_H123Y_E134G_D147Y_E155V_I156F),
(H36L_L84F_A106V_D108N_H123Y_D147Y_E155V_I156F_K157N),
(H36L_L84F_A106V_D108N_H123Y_S146C_D147Y_E155V_I156F),
(L84F_A106V_D108N_H123Y_S146R_D147Y_E155V_I156F_K16IT),
(N37S_R51H_D77G_L84F_A106V_D108N_H123Y_D147Y_E155V_I156F),
(R51L_L84F_A106V_D108N_H123Y_D147Y_E155V_I156F_K157N),
(D24G_Q71R_L84F_H96L_A106V_D108N_H123Y_D147Y_E155V_I156F_K160E),
(H36L_G67V_L84F_A106V_D108N_H123Y_S146T_D147Y_E155V_I156F),
(Q71L_L84F_A106V_D108N_H123Y_L137M_A143E_D147Y_E155V_I156F),
(E25G_L84F_A106V_D108N_H123Y_D147Y_E155V_I156F_Q159L),
(L84F_A91T_F104I_A106V_D108N_H123Y_D147Y_E155V_I156F),
(N72D_L84F_A106V_D108N_H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_E155V_I156F),
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S146C_D147Y_E155V_I156F_K157N),
(N37S_L84F_A106V_D108N_H123Y_A142N_D147Y_E155V_I156F_K161T),
(L84F_A106V_D108N_D147Y_E155V_I156F),
(R51L_L84F_A106V_D108N_H123Y_S146C_D147Y_E155V_I156F_K157N_K161T),
(L84F_A106V_D108N_H123Y_S146C_D147Y_E155V_I156F_K161T),
(L84F_A106V_D108N_H123Y_S146C_D147Y_E155V_I156F_K157N_K160E_K161T),
(L84F_A106V_D108N_H123Y_S146C_D147Y_E155V_I156F_K157N_K160E), (R74Q_L84F_A106V_D108N_H123Y_D147Y_E155V_I156F),
(R74A_L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F),
(L84F_R98Q_A106V_D108N_H123Y_D147Y_E155V_I156F),
(L84F_A106V_D108N_H123Y_R129Q_D147Y_E155V_I156F),
(P48S_L84F_A106V_D108N_H123Y_A142N_D147Y_E155V_I156F), (P48S_A142N),
(P48T_149V_L84F_A106V_D108N_H123Y_A142N_D147Y_E155V_I156F_L157N),
(P48T_I49V_A142N),
(H36L_P48S_R51L_L84F_A106V_D108N_H123Y_S146C_D147Y_E155V_I156F_K157N),
(H36L_P48S_R51L_L84F_A106V_D108N_H123Y_S146C_A142N_D147Y_E155V_I156F_K157N),
(H36L_P48T_149V_R51L_L84F_A106V_D108N_H123Y_S146C_D147Y_E155V_I156F K157N),
(H36L_P48T_149V_R51L_L84F_A106V_D108N_H123Y_A142N_S146C_D147Y_E155V_I156F_K157N),
(H36L_P48A_R51L_L84F_A106V_D108N_H123Y_S146C_D147Y_E155V_I156F_K157N),
(H36L_P48A_R51L_L84F_A106V_D108N_H123Y_

A142N_S146C_D147Y_E155V_I156F K157N), (H36L_P48A_R51L_L84F_A106V_D108N_H123Y_ S146C_A142N_D147Y_E155V_I156F K157N), (W23L_H36L_P48A_R51L_L84F_A106V_D108N_ H123Y_S146C_D147Y_E155V_I156F K157N), (W23R_H36L_P48A_R51L_L84F_A106V_D108N_ H123Y_S146C_D147Y_E155V_I156F K157N), (W23L_H36L_P48A_R51L_L84F_A106V_D108N_ H123Y_S146R_D147Y_E155V_I156F_K161T), (H36L_P48A_R51L_L84F_A106V_D108N_H123Y_ S146C_D147Y_R152H_E155V_I156F K157N), (H36L_P48A_R51L_L84F_A106V_D108N_H123Y_ S146C_D147Y_R152P_E155V_I156F K157N), (W23L_H36L_P48A_R51L_L84F_A106V_D108N_ H123Y_S146C_D147Y_R152P_E155V I156F_K157N), (W23L_H36L_P48A_R51L_L84F_A106V_D108N_ H123Y_A142A_S146C_D147Y_E155V I156F_K157N), (W23L_H36L_P48A_R51L_L84F_A106V_D108N_ H123Y_A142A_S146C_D147Y_R152P E155V_I156F_K157N), (W23L_H36L_P48A_R51L_L84F_A106V_D108N_ H123Y_S146R_D147Y_E155V_I156F K161T), (W23R_H36L_P48A_R51L_L84F_A106V_D108N_ H123Y_S146C_D147Y_R152P_E155V I156F_K157N), (H36L_P48A_R51L_L84F_A106V_D108N_H123Y_ A142N_S146C_D147Y_R152P_E155V_I156F_K157N).

In some embodiments, fusion proteins as provided herein comprise the full-length amino acid of a nucleic acid editing enzyme, e.g., one of the sequences provided above. In other embodiments, however, fusion proteins as provided herein do not comprise a full-length sequence of a nucleic acid editing enzyme, but only a fragment thereof. For example, in some embodiments, a fusion protein provided herein comprises a napDNAbp and a fragment of a nucleic acid editing enzyme, e.g., wherein the fragment comprises a nucleic acid editing domain. Exemplary amino acid sequences of nucleic acid editing domains are shown in the sequences above, and additional suitable sequences of such domains will be apparent to those of ordinary skill in the art based on this disclosure and knowledge in the field. Additional suitable nucleic-acid editing enzyme sequences, e.g., deaminase enzyme and domain sequences, e.g., that can be fused to a napDNAbp (e.g., a nuclease-inactive Cas9 domain), will be apparent to those of ordinary skill in the art based on this disclosure. In some embodiments, such additional enzyme sequences include deaminase enzyme or deaminase domain sequences that are at least 70%, at least 75%, at least 80%, at least 85%, at least 90%, at least 95%, at least 96%, at least 97%, at least 98%, or at least 99% similar to the sequences provided herein. Additional suitable napDNAbps (e.g., Cas9 domains), variants, and sequences will also be apparent to those of ordinary skill in the art. Examples of such additional suitable Cas9 domains include, but are not limited to, D10A, D10A/D839A/H840A, and D10A/D839A/H840A/N863A mutant domains (see, e.g., Prashant et al., CAS9 transcriptional activators for target specificity screening and paired nickases for cooperative genome engineering. *Nature Biotechnology.* 2013; 31(9): 833-838; the entire contents of which are incorporated herein by reference). In some embodiments, the Cas9 comprises a histidine residue at position 840 of the amino acid sequence provided in SEQ ID NO: 10, or a corresponding mutation in any of the amino acid sequences provided in SEQ ID NOs: 11-260. The presence of the catalytic residue H840 restores the activity of the Cas9 to cleave the non-edited strand containing a G opposite the targeted C. Restoration of H840 does not result in the cleavage of the target strand containing the C.

Fusion Proteins

Any of the nucleic acid programmable DNA binding proteins (e.g, Cas9 domains (e.g., a nuclease active Cas9 domain, a nuclease-inactive dCas9 domain, or a Cas9 nickase domain) disclosed herein may be fused to a second protein, thus providing fusion proteins that comprise a napDNAbp as provided herein and a second protein, or a "fusion partner." In some embodiments, the second protein is a nucleic acid editing domain. Some aspects of the disclosure provide fusion proteins comprising a nucleic acid programmable DNA binding protein (napDNAbp) and a nucleic acid editing domain.

In some embodiments, the second protein is fused to the N-terminus of the napDNAbp. However, in other embodiments, the second protein is fused to the C-terminus of the napDNAbp. In some embodiments, the second protein that is fused to the napDNAbp is a nucleic acid editing domain. In some embodiments, the napDNAbp and the nucleic acid editing domain are fused via a linker, while in other embodiments, the napDNAbp and the nucleic acid editing domain are fused directly to one another. In some embodiments, the linker comprises the amino acid sequence of any one of SEQ ID NOs: 300-318. In some embodiments, a linker comprises the amino acid sequence SGSETPGTSESATPES (SEQ ID NO: 306), which may also be referred to as an XTEN linker in the Examples and Figures. In some embodiments, a linker comprises the amino acid sequence SGGS (SEQ ID NO: 309). In some embodiments, a linker comprises the amino acid sequence $(SGGS)_2$-SGSETPGTSESATPES-$(SGGS)_2$ (SEQ ID NO: 308), which may also be referred to as $(SGGS)_2$-XTEN-$(SGGS)_2$. In some embodiments, a linker comprises $(SGGS)_n$ (SEQ ID NO: 305), $(GGGS)_n$ (SEQ ID NO: 300), $(GGGGS)_n$ (SEQ ID NO: 301), $(G)_n$ (SEQ ID NO: 302), $(EAAAK)_n$ (SEQ ID NO: 303), $(GGS)_n$ (SEQ ID NO: 304), $SGGS(GGS)_n$ (SEQ ID NO: 307), $(SGGS)_n$-SGSETPGTSESATPES-$(SGGS)_n$ (SEQ ID NO: 310), or $(XP)_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, n is 1, 3, or 7. The length of the linker can influence the base to be edited, as illustrated, for example, in International Patent Application No. PCT/US2016/058344, filed Oct. 22, 2016, published as publication number WO2017/070632 on Apr. 27, 2017, the contents of which is incorporated herein by reference. For example, a linker of 3-amino-acid long (e.g., $(GGS)_1$) may give a 2-5, 2-4, 2-3, 3-4 base editing window relative to the PAM sequence, while a 9-amino-acid linker (e.g., $(GGS)_3$ (SEQ ID NO: 311)) may give a 2-6, 2-5, 2-4, 2-3, 3-6, 3-5, 3-4, 4-6, 4-5, 5-6 base editing window relative to the PAM sequence. A 16-amino-acid linker (e.g., the XTEN linker) may give a 2-7, 2-6, 2-5, 2-4, 2-3, 3-7, 3-6, 3-5, 3-4, 4-7, 4-6, 4-5, 5-7, 5-6, 6-7 base window relative to the PAM sequence with exceptionally strong activity, and a 21-amino-acid linker (e.g., $(GGS)_7$ (SEQ ID NO: 312)) may give a 3-8, 3-7, 3-6, 3-5, 3-4, 4-8, 4-7, 4-6, 4-5, 5-8, 5-7, 5-6, 6-8, 6-7, 7-8 base editing window relative to the PAM sequence. Since a PAM sequence may be of varying distance to a target nucleobase in a target DNA sequence (e.g., a disease-causing mutation to be corrected in a gene), varying the linker length permits the fusion proteins described herein to edit a nucleobase at different distances from the PAM sequence. It is to be understood that the linker lengths described as examples are not meant to be limiting.

Some aspects of this disclosure provide fusion proteins comprising (i) a napDNAbp and (ii) a nucleic acid editing domain. In some embodiments, the general architecture of exemplary fusion proteins provided herein comprises the structure:

[NH₂]-[nucleic acid editing domain]-[napDNAbp]-[COOH],

[NH₂]-[nucleic acid editing domain]-[linker]-[napDNAbp]-[COOH],

[NH₂]-[napDNAbp]-[nucleic acid editing domain]-[COOH], or

[NH₂]-[napDNAbp]-[linker]-[nucleic acid editing domain]-[COOH]

wherein NH₂ is the N-terminus of the fusion protein, and COOH is the C-terminus of the fusion protein. In some embodiments, the "]-[" used in the general architecture above indicates the presence of an optional linker sequence.

In some embodiments, the fusion protein comprises (i) a nuclease-inactive Cas9 domain; and (ii) a nucleic acid editing domain. In some embodiments, a nuclease-inactive Cas9 domain (e.g., dCas9, Cas9n), comprises an amino acid sequence that is at least 80%, at least 85%, at least 90%, at least 92%, at least 95%, at least 96%, at least 97%, at least 98%, at least 99%, or at least 99.5% identical to the amino acid sequence of a Cas9 as provided by any one of SEQ ID NOS: 10-260, and comprises mutations that inactivate the nuclease activity of Cas9. Mutations that render the nuclease domains of Cas9 inactive are well-known in the art. For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)). In some embodiments, the nuclease inactive Cas9 domain is a dCas9 domain. In some embodiments, the nuclease inactive Cas9 domain is a Cas9n domain. In some embodiments, the nuclease inactive Cas9 domain comprises a D10A mutation of the amino acid sequence provided in SEQ ID NO: 10, or a corresponding mutation in any of the amino acid sequences provided in SEQ ID NOs: 11-260. In some embodiments, the nuclease inactive Cas9 domain comprises a H840A mutation of the amino acid sequence provided in SEQ ID NO: 10, or a corresponding mutation in any of the amino acid sequences provided in SEQ ID NOs: 11-260. In some embodiments, the nuclease inactive Cas9 domain comprises both D10A and H840A mutations of the amino acid sequence provided in SEQ ID NO: 10, or a corresponding mutation in any of the amino acid sequences provided in SEQ ID NOs: 11-260. In some embodiments, the nuclease inactive Cas9 domain comprises an amino acid sequence of SEQ ID NO: 6. In some embodiments, the nuclease inactive Cas9 further comprises a histidine residue at position 840 of the amino acid sequence provided in SEQ ID NO: 10, or a corresponding mutation in any of the amino acid sequences provided in SEQ ID NOs: 11-260. For example, the presence of the catalytic residue H840 restores the activity of the dCas9 to cleave the non-edited strand (i.e., the Cas9 domain is a Cas9 nickase) containing, for example, a G opposite the targeted C. Restoration of H840 does not result in the cleavage of the target strand containing the C. In some embodiments, the nuclease inactive Cas9 domain comprises an amino acid sequence of SEQ ID NO: 7. It is to be understood that other mutations that inactivate the nuclease domains of Cas9 may also be included in the nuclease inactive Cas9 domain (e.g., dCas9, Cas9n) of this disclosure.

The Cas9 domains or nuclease inactive Cas9 domains comprising the mutations disclosed herein may be a full-length Cas9 domain, or a fragment thereof. In some embodiments, proteins comprising a Cas9 domain, or fragments thereof, are referred to as "Cas9 variants." A Cas9 variant shares homology to a Cas9 domain, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9, e.g., a Cas9 comprising the amino acid sequence of SEQ ID NO: 10. In some embodiments, the wild-type Cas9 domain comprises the amino acid sequence of any one of SEQ ID NOs: 10-260.

Any of the napDNAbp fusion proteins of this disclosure may further comprise a nucleic acid editing domain (e.g., an enzyme that is capable of modifying nucleic acid, such as a deaminase). In some embodiments, the nucleic acid editing domain is a DNA-editing domain. In some embodiments, the nucleic acid editing domain has deaminase activity. In some embodiments, the nucleic acid editing domain comprises or consists of a deaminase or deaminase domain. In some embodiments, the deaminase domain is a cytidine deaminase domain. In some embodiments, the cytidine deaminase domain is an apolipoprotein B mRNA-editing complex (APOBEC) family deaminase domain. In some embodiments, the cytidine deaminase domain is an APOBEC1 family deaminase domain. In some embodiments, the cytidine deaminase domain is an activation-induced cytidine deaminase (AID) domain. In some embodiments, the deaminase domain is an adenosine deaminase. In some embodiments, the adenosine deaminase domain is an ecTadA deaminase domain, or a variant thereof. Some nucleic-acid editing domains, as well as napDNAbp (e.g., Cas9 domain) fusion proteins including such domains, are described in detail herein. Additional suitable nucleic acid editing domains will be apparent to a person of ordinary skill in the art based on this disclosure and knowledge in the field.

Some aspects of the disclosure provide a fusion protein comprising a Cas9 domain fused to a nucleic acid editing domain, wherein the nucleic acid editing domain is fused to the N-terminus of the Cas9 domain. In some embodiments, the Cas9 domain and the nucleic acid editing-editing domain are fused via a linker. In some embodiments, the linker comprises a $(GGGS)_n$ (SEQ ID NO: 300), a $(GGGGS)_n$ (SEQ ID NO: 301), a $(G)_n$ (SEQ ID NO: 302), an $(EAAAK)_n$ (SEQ ID NO: 303), a $(GGS)_n$ (SEQ ID NO: 304), $(SGGS)_n$ (SEQ ID NO: 305), an SGSETPGTSESATPES (SEQ ID NO: 306) motif (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference), a $SGGS(GGS)_n$ (SEQ ID NO: 307), $(SGGS)_n$-SGSETPGTSESATPES-$(SGGS)_n$ (SEQ ID NO: 310), or an $(XP)_n$ motif, or a combination of any of these, wherein n is independently an integer between 1 and 30. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. In some embodiments, the linker comprises a (GGS)$_n$ motif, wherein n is 1, 2, 3, 4, 5, 6, 7, 8, 9, 10, 11, 12, 13, 14 or 15. In some embodiments, the linker comprises a (GGS)$_n$ motif, wherein n is 1, 3, or 7. In some embodiments, the linker comprises the amino acid sequence SGSETPGTSESATPES (SEQ ID NO: 306). In some embodiments, the linker comprises the amino acid sequence (SGGS)$_2$-SGSETPGTSESATPES-(SGGS)$_2$ (SEQ ID NO: 308). Additional suitable linker motifs and linker configurations will be apparent to those of ordinary skill in the art. In some embodiments, suitable linker motifs and configurations include those described in Chen et al., Fusion protein linkers: property, design and functionality. *Adv Drug Deliv Rev.* 2013; 65(10): 1357-69, the entire contents of which are incorporated herein by reference. Additional suitable linker sequences will be apparent to those of ordinary skill in the art based on the instant disclosure. In some embodiments, the general architecture of exemplary Cas9 fusion proteins provided herein comprises the structure:

[NH$_2$]-[nucleic acid editing domain]-[Cas9 domain]-[COOH] or

[NH$_2$]-[nucleic acid editing domain]-[linker]-[Cas9 domain]-[COOH], wherein NH$_2$ is the N-terminus of the fusion protein, and COOH is the C-terminus of the fusion protein. In some embodiments, the "]-[" used in the general architecture above indicates the presence of an optional linker sequence.

The fusion proteins of the present disclosure may comprise one or more additional features. For example, in some embodiments, the fusion protein comprises a nuclear localization sequence (NLS). In some embodiments, the NLS of the fusion protein is localized between the nucleic acid editing domain and the Cas9 domain. In some embodiments, the NLS of the fusion protein is localized C-terminal to the Cas9 domain. In some embodiments, the NLS comprises the amino acid sequence of SEQ ID NO: 520. In some embodiments, the NLS comprises the amino acid sequence of SEQ ID NO: 521.

Other exemplary features that may be present are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FLASH tags, V5 tags, and SBP-tags. Additional suitable sequences will be apparent to those of ordinary skill in the art. In some embodiments, the fusion protein comprises one or more His tags.

In some embodiments, the nucleic acid editing domain is a deaminase. In some embodiments, the deaminase is a cytidine deaminase. For example, in some embodiments, the general architecture of exemplary Cas9 fusion proteins with a cytidine deaminase domain comprises the structure:

[NH$_2$]-[NLS]-[cytidine deaminase]-[Cas9]-[COOH],
[NH$_2$]-[Cas9]-[cytidine deaminase]-[COOH],
[NH$_2$]-[cytidine deaminase]-[Cas9]-[COOH], or
[NH$_2$]-[cytidine deaminase]-[Cas9]-[NLS]-[COOH]

wherein NLS is a nuclear localization sequence, NH$_2$ is the N-terminus of the fusion protein, and COOH is the C-terminus of the fusion protein. Nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 520) or MDSLLMNRRKFLYQFKNVRWAKGR-RETYLC (SEQ ID NO: 521). In some embodiments, a linker is inserted between the Cas9 and the cytidine deaminase. In some embodiments, the NLS is located C-terminal of the Cas9 domain. In some embodiments, the NLS is located N-terminal of the Cas9 domain. In some embodiments, the NLS is located between the cytidine deaminase and the Cas9 domain. In some embodiments, the NLS is located N-terminal of the cytidine deaminase domain. In some embodiments, the NLS is located C-terminal of the cytidine deaminase domain. In some embodiments, the "]-[" used in the general architecture above indicates the presence of an optional linker sequence.

In some embodiments, the fusion protein comprises any one of nucleic acid editing domains provided herein. In some embodiments, the nucleic acid editing domain is a cytidine deaminase domain provided herein. In some embodiments, the nucleic acid editing domain is a cytidine deaminase domain comprising the amino acid sequence set for in any one of SEQ ID NOs: 350-389.

In some embodiments, the cytidine deaminase domain and the Cas9 domain are fused to each other via a linker. Various linker lengths and flexibilities between the deaminase domain (e.g., AID, APOBEC family deaminase) and the Cas9 domain can be employed, for example, ranging from very flexible linkers of the form (GGGS)$_n$ (SEQ ID NO: 300), (GGGGS)$_n$ (SEQ ID NO: 301), (GGS)$_n$ (SEQ ID NO: 304), and (G)$_n$ (SEQ ID NO: 302), to more rigid linkers of the form (EAAAK)$_n$ (SEQ ID NO: 303), (SGGS)$_n$ (SEQ ID NO: 305), SGGS(GGS)$_n$ (SEQ ID NO: 307), SGSETPGTSESATPES (SEQ ID NO: 306) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference), (SGGS)$_n$-SGSETPGTSESATPES-(SGGS)$_n$ (SEQ ID NO: 310), and (XP)$_n$, wherein n is an integer between 1 and 30, inclusive, in order to achieve the optimal length for deaminase activity for the specific application. In some embodiments, the linker comprises a (GGS)$_n$ motif, wherein n is 1, 3, or 7. In some embodiments, the linker comprises a SGSETPGTSESATPES (SEQ ID NO: 306) motif. In some embodiments, the linker comprises a (SGGS)$_2$-SGSETPGT-SESATPES-(SGGS)$_2$ (SEQ ID NO: 308) motif.

In some embodiments, the fusion protein comprises a nuclease-inactive Cas9 domain (e.g., a dCas9 domain or a Cas9n domain) fused to a cytidine deaminase domain, wherein the fusion protein comprises or consists of the amino acid sequence of any one of SEQ ID NOs: 540-542.

BE1 for bacterial cell (e.g., *E. Coli*) expression (His6-rAPOBEC1-XTEN-dCas9)
(SEQ ID NO: 540)
MGSSHHHHHHMSSETGPVAVDPTLRRRIEPHEFEVFFDPRELRKETCLLYEINWGGRHSIWRHTSQNTN

KHVEVNFIEKFTTERYFCPNTRCSITWFLSWSPCGECSRAITEFLSRYPHVTLFIYIARLYHHADPRNRQGL

-continued

RDLISSGVTIQIMTEQESGYCWRNFVNYSPSNEAHWPRYPHLWVRLYVLELYCIILGLPPCLNILRRKQPQ

LTFFTIALQSCHYQRLPPHILWATGLKSGSETPGTSESATPESDKKYSIGLAIGTNSVGWAVITDEYKVPSK

KFKVLGNTDRHSIKKNLIGALLFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKNLSDAILLSKILRVNTEITKAPLSA

SMIKRYDEHHQDLTLLKALVRQQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKIEKILTFRIPYYVGPLARGNSRF

AWMTRKSEETITPWNFEEVVDKGASAQSFIERMTNFDKNLPNEKVLPKHSLLYEYFTVYNELTKVKYVTE

GMRKPAFLSGEQKKAIVDLLFKTNRKVTVKQLKEDYFKKIECFDSVEISGVEDRFNASLGTYHDLLKIIKDK

DFLDNEENEDILEDIVLTLTLFEDREMIEERLKTYAHLFDDKVMKQLKRRRYTGWGRLSRKLINGIRDKQS

GKTILDFLKSDGFANRNFMQLIHDDSLTFKEDIQKAQVSGQGDSLHEHIANLAGSPAIKKGILQTVKVVDEL

VKVMGRHKPENIVIEMARENQTTQKGQKNSRERMKRIEEKIGELGSQILKEHPVENTQLQNEKLYYYLQ

NGRDMYVDQELDINRLSDYDVDAIVPQSFLKDDSIDNKVLTRSDKNRGKSDNVPSEEVVKKMKNYWRQL

LNAKLITQRKFDNLTKAERGGLSELDKAGFIKRQLVETRQITKHVAQILDSRMNTKYDENDKLIREVKVITLK

SKLVSDFRKDFQFYKVREINNYHHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGNELALPSKYVNFLYLASHYEKL

KGSPEDNEQKQLKFVQHKHYLDEIIEQISEFSKRVILADANLDKVLSAYNKHRDKPIREQAENIIHLFTLTNL

GAPAAFKYFDTTIDRKRYTSTKEVLDATLIHQSITGLYETRIDLSQLGGDSGGSPKKKRKV

BE1 for expression in eukaryotic cells (e.g., mammalian cells) (rAPOBEC1-XTEN-
dCas9-NLS)

(SEQ ID NO: 541)

MSSETGPVAVDPTLRRRIEPHEFEVFFDPRELRKETCLLYEINWGGRHSIWRHTSQNTNKHVEVNFIEKF

TTERYFCPNTRCSITWFLWSPCGECSRAITEFLSRYPHVTLFIYIARLYHHADPRNRQGLRDLISSGVTIQ

IMTEQESGYCWRNFVNYSPSNEAHWPRYPHLWVRLYVLELYCIILGLPPCLNILRRKQPQLTFFTIALQSC

HYQRLPPHILWATGLKSGSETPGTSESATPESDKKYSIGLAIGTNSVGWAVITDAYKVPSKKFKVLGNTDR

HSIKKNLIGALLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRIYLALAHMIKFRGHFLIEGDLNPDNSDVDKLF

IQLVQTYNQLFEENPINASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITKAPLSASMIKRYDEHHQ

DLTLLKALVRQQLPEKYKEIFFDQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYVGPLARGNSRFAWMTRKSEETITP

WNFEEVVDKGASAQSFIERMTNFDKNLPNEKVLPKHSLLYEYFTVYNELTKVKYVTEGMRKPAFLSGEQ

KKAIVDLLFKTNRKVTVKQLKEDYFKKIECFDSVEISGVEDRFNASLGTYHDLLKIIKDKDFLDNEENEDILE

DIVLTLTLFEDREMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLYYYLQNGRDMYVDQELDI

NRLSDYDVDAIVPQSFLKDDSIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDDKLIREVKVITLKSKLVSDFRKDFQF

YKVREINNYHHAHDAYLNAVVGTALIKKYPKLESEFVYGDYKVYDVRKMIAKSEQEIGKATAKYFFYSNIM

```
NFFKTEITLANGEIRKRPLIETNGETGEIVWDKGRDFATVRKVLSMPQVNIVKKTEVQTGGFSKESILPKRN

SDKLIARKKDWDPKKYGGFDSPTVAYSVLVVAKVEKGKSKKLKSVKELLGITIMERSSFEKNPIDFLEAKG

YKEVKKDLIIKLPKYSLFELENGRKRMLASAGELQKGNELALPSKYVNFLYLASHYEKLKGSPEDNEQKQL

FVEQHKHYLDEIIEQISEFSKRVILADANLDKVLSAYNKHRDKPIREQAENIIHLFTLTNLGAPQQFKYFDTTI

DRKRYTSTKEVLDATLIHQSITGLYETRIDLSQLGGDSGGSPKKKRKV
```

Alternative BE1 for expression in eukaryotic cells (e.g., mammalian cells) with human APOBEC1 (hAPOBEC1-XTEN-dCas9-NLS)

(SEQ ID NO: 542)

```
MTSEKGPSTGDPTLRRRIEPWEFDVFYDPRELRKEACLLYEIKWGMSRKIWRSSGKNTTNHVEVNFIKKFTSER

DFHPSMSCSITWFLSWSPCWECSQAIREFLSRHPGVTLVIYVARLFWHMDQQNRQGLRDLVNSGVTIQIMRASE

YYHCWRNFVNYPPGDEAHWPQYPPLWMMLYALELHCIILSLPPCLKISRRWQNHLTFFRLHLQNCHYQTIPPHI

LLATGLIHPSVAWRGSETPGTSESATPESDKKYSIGLAIGTNSVGWAVITDEYKVPSKKFKVLGNTDRHSIKKN

LIGALLFDSGETAEATRLKRTARRRYTRRKNRICYLQEIFSNEMAKVDDSFFHRLEESFLVEEDKKHERHPIFG

NIVDEVAYHEKYPTIYHLRKKLVDSTDKADLRLIYLALAHMIKFRGHFLIEGDLNPDNSDVDKLFIQLVQTYNQ

LFEENPINASGVDAKAILSARLSKSRRLENLIAQLPGEKKNGLFGNLIALSLGLTPNFKSNFDLAEDAKLQLSK

DTYDDDLDNLLAQIGDQYADLFLAAKNLSDAILLSDILRVNTEITKAPLSASMIKRYDEHHQDLTLLKALVRQQ

LPEKYKEIFFDQSKNGYAGYIDGGASQEEFYKFIKPILEKMDGTEELLVKLNREDLLRKQRTFDNGSIPHQIHL

GELHAILRRQEDFYPFLKDNREKIEKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFLSGEQKKAIVDLLFKTNRKVTVKQL

KEDYFKKIECFDSVEISGVEDRFNASLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDAIVPQSFLKDDSIDNKVLTRS

DKNRGKSDNVPSEEVVKKMKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYLNAVVGTALIKKYPKLESEF

VYGDYKVYDVRKMIAKSEQEIGKATAKYFFYSNIMNFFKTEITLANGEIRKRPLIETNGETGEIVWDKGRDFAT

VRKVLSMPQVNIVKKTEVQTGGFSKESILPKRNSDKLIARKKDWDPKKYGGFDSPTVAYSVLVVAKVEKGKSKK

LKSVKELLGITIMERSSFEKNPIDFLEAKGYKEVKKDLIIKLPKYSLFELENGRKRMLASAGELQKGNELALPS

KYVNFLYLASHYEKLKGSPEDNEQKQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITGLYETRIDLSQLGGDSGGSPKKKRK

V
```

Some aspects of the disclosure relate to fusion proteins that comprise a uracil glycosylase inhibitor (UGI) domain. In some embodiments, any of the fusion proteins provided herein that comprise a Cas9 domain (e.g., a nuclease active Cas9 domain, a nuclease inactive dCas9 domain, or a Cas9 nickase) may be further fused to a UGI domain either directly or via a linker. Some aspects of this disclosure provide deaminase-dCas9 fusion proteins, deaminase-nuclease active Cas9 fusion proteins and deaminase-Cas9 nickase fusion proteins with increased nucleobase editing efficiency. Without wishing to be bound by any particular theory, cellular DNA-repair response to the presence of U:G heteroduplex DNA may be responsible for the decrease in nucleobase editing efficiency in cells. For example, uracil DNA glycosylase (UDG) catalyzes removal of U from DNA in cells, which may initiate base excision repair, with reversion of the U:G pair to a C:G pair as the most common outcome. As demonstrated in the Examples below, Uracil DNA Glycosylase Inhibitor (UGI) may inhibit human UDG activity. Thus, this disclosure contemplates a fusion protein comprising a napDNAbp (e.g, a Cas9 nuclease, dCas9, or Cas9n) and a nucleic acid editing domain (e.g., a deaminase) further fused to a UGI domain. In some embodiments, the fusion protein comprising a Cas9 nickase-nucleic acid editing domain further fused to a UGI domain. In some embodiments, the fusion protein comprising a dCas9-nucleic acid editing domain further fused to a UGI domain. It should be understood that the use of a UGI domain may increase the editing efficiency of a nucleic acid editing domain that is capable of catalyzing, for example, a C to U change. For example, fusion proteins comprising a UGI domain may be more efficient in deaminating C residues.

In some embodiments, the fusion protein comprises the structure:

[nucleic acid editing domain]-[optional linker sequence]-[napDNAbp]-[optional linker sequence]-[UGI];
[nucleic acid editing domain]-[optional linker sequence]-[UGI]-[optional linker sequence]-[napDNAbp];
[UGI]-[optional linker sequence]-[nucleic acid editing domain]-[optional linker sequence]-[napDNAbp];
[UGI]-[optional linker sequence]-[napDNAbp]-[optional linker sequence]-[nucleic acid editing domain];
[napDNAbp]-[optional linker sequence]-[nucleic acid editing domain]-[optional linker sequence]-[UGI]; or
[napDNAbp]-[optional linker sequence]-[UGI]-[optional linker sequence]-[nucleic acid editing domain].

In some embodiments, the fusion protein comprises the structure:

[deaminase]-[optional linker sequence]-[dCas9]-[optional linker sequence]-[UGI];
[deaminase]-[optional linker sequence]-[UGI]-[optional linker sequence]-[dCas9];
[UGI]-[optional linker sequence]-[deaminase]-[optional linker sequence]-[dCas9];
[UGI]-[optional linker sequence]-[dCas9]-[optional linker sequence]-[deaminase];
[dCas9]-[optional linker sequence]-[deaminase]-[optional linker sequence]-[UGI]; or
[dCas9]-[optional linker sequence]-[UGI]-[optional linker sequence]-[deaminase].

In other embodiments, the fusion protein comprises the structure:

[deaminase]-[optional linker sequence]-[Cas9 nickase]-[optional linker sequence]-[UGI];
[deaminase]-[optional linker sequence]-[UGI]-[optional linker sequence]-[Cas9 nickase];
[UGI]-[optional linker sequence]-[deaminase]-[optional linker sequence]-[Cas9 nickase];
[UGI]-[optional linker sequence]-[Cas9 nickase]-[optional linker sequence]-[deaminase];
[Cas9 nickase]-[optional linker sequence]-[deaminase]-[optional linker sequence]-[UGI]; or
[Cas9 nickase]-[optional linker sequence]-[UGI]-[optional linker sequence]-[deaminase].

In some embodiments, the fusion protein comprises the structure:

[cytidine deaminase]-[optional linker sequence]-[dCas9]-[optional linker sequence]-[UGI];
[cytidine deaminase]-[optional linker sequence]-[UGI]-[optional linker sequence]-[dCas9];
[UGI]-[optional linker sequence]-[cytidine deaminase]-[optional linker sequence]-[dCas9];
[UGI]-[optional linker sequence]-[dCas9]-[optional linker sequence]-[cytidine deaminase];
[dCas9]-[optional linker sequence]-[cytidine deaminase]-[optional linker sequence]-[UGI]; or
[dCas9]-[optional linker sequence]-[UGI]-[optional linker sequence]-[cytidine deaminase].

In other embodiments, the fusion protein comprises the structure:

[cytidine deaminase]-[optional linker sequence]-[Cas9 nickase]-[optional linker sequence]-[UGI];
[cytidine deaminase]-[optional linker sequence]-[UGI]-[optional linker sequence]-[Cas9 nickase];
[UGI]-[optional linker sequence]-[cytidine deaminase]-[optional linker sequence]-[Cas9 nickase];
[UGI]-[optional linker sequence]-[Cas9 nickase]-[optional linker sequence]-[cytidine deaminase];
[Cas9 nickase]-[optional linker sequence]-[cytidine deaminase]-[optional linker sequence]-[UGI]; or
[Cas9 nickase]-[optional linker sequence]-[UGI]-[optional linker sequence]-[cytidine deaminase].

In some embodiments, the fusion proteins provided herein do not comprise a linker sequence. In some embodiments, one or both of the optional linker sequences are present.

In some embodiments, the "-" used in the general architecture above indicates the presence of an optional linker sequence. In some embodiments, the fusion proteins comprising a UGI further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the UGI protein. In some embodiments, the NLS is fused to the C-terminus of the UGI protein. In some embodiments, the NLS is fused to the N-terminus of the Cas9 protein. In some embodiments, the NLS is fused to the C-terminus of the Cas9 protein. In some embodiments, the NLS is fused to the N-terminus of the deaminase. In some embodiments, the NLS is fused to the C-terminus of the deaminase. In some embodiments, the NLS is fused to the N-terminus of the second Cas9. In some embodiments, the NLS is fused to the C-terminus of the second Cas9. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 520 or SEQ ID NO: 521.

In some embodiments, a UGI domain comprises a wild-type UGI or a UGI as set forth in SEQ ID NO: 500. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 500. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 500. In some embodiments, a UGI comprises an amino acid sequence homologous to the amino acid sequence set forth in SEQ ID NO: 500 or an amino acid sequence homologous to a fragment of the amino acid sequence set forth in SEQ ID NO: 500. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 500. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 500. In some embodiments, the UGI comprises the following amino acid sequence:

```
Uracil-DNA glycosylase inhibitor (>sp|1314739|
UNGI_BPPB2)
                                    (SEQ ID NO: 500)
MTNLSDIIEKETGKQLVIQESILMLPEEVEEVIGNKPESDILVHTAYDEST
DENVMLLTSDAPEYKPWALVIQDSNGENKIKML
```

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), the entire contents of each of which are incorporated herein by reference.

It should be appreciated that additional proteins may be uracil glycosylase inhibitors. For example, other proteins that are capable of inhibiting (e.g., sterically blocking) a uracil-DNA glycosylase base-excision repair enzyme are within the scope of this disclosure. Additionally, any proteins that block or inhibit base-excision repair as also within the scope of this disclosure. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a *Erwinia tasmaniensis* single-stranded binding protein. In some embodiments, the single-stranded binding protein comprises the amino acid sequence (SEQ ID NO: 501). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 502). As another example, a uracil glycosylase inhibitor is a catalytically inactive UDG. In some embodiments, a catalytically inactive UDG comprises the amino acid sequence (SEQ ID NO: 503). It should be appreciated that other uracil glycosylase inhibitors would be apparent to the skilled artisan and are within the scope of this disclosure. In some embodiments, a uracil glycosylase inhibitor is a protein that is homologous to any one of SEQ ID NOs: 501-503. In some embodiments, a uracil glycosylase inhibitor is a protein that is at least 50% identical, at least 55% identical, at least 60% identical, at least 65% identical, at least 70% identical, at least 75% identical, at least 80% identical at least 85% identical, at least 90% identical, at least 95% identical, at least 96% identical, at least 98% identical, at least 99% identical, or at least 99.5% identical to any one of SEQ ID NOs: 501-503.

```
Erwinia tasmaniensis SSB (themostable single-
stranded DNA binding protein)
                                    (SEQ ID NO: 501)
MASRGVNKVILVGNLGQDPEVRYMPNGGAVANITLATSESWRDKQTGETK

EKTEWHRVVLFGKLAEVAGEYLRKGSQVYIEGALQTRKWTDQAGVEKYTT

EVVVNVGGTMQMLGGRSQGGGASAGGQNGGSNNGWGQPQQPQGGNQFSGG

AQQQARPQQQPQQNNAPANNEPPIDFDDDIP

UdgX (binds to Uracil in DNA but does not excise)
                                    (SEQ ID NO: 502)
MAGAQDFVPHTADLAELAAAAGECRGCGLYRDATQAVFGAGGRSARIMMI

GEQPGDKEDLAGLPFVGPAGRLLDRALEAADIDRDALYVTNAVKHFKFTR

AAGGKRRIHKTPSRTEVVACRPWLIAEMTSVEPDVVVLLGATAAKALLGN

DFRVTQHRGEVLHVDDVPGDPALVATVHPSSLLRGPKEERESAFAGLVDD

LRVAADVRP

UDG (catalytically inactive human UDG, binds to
Uracil in DNA but does not excise)
                                    (SEQ ID NO: 503)
MIGQKTLYSFFSPSPARKRHAPSPEPAVQGTGVAGVPEESGDAAAIPAKK

APAGQEEPGTPPSSPLSAEQLDRIQRNKAAALLRLAARNVPVGFGESWKK

HLSGEFGKPYFIKLMGFVAEERKHYTVYPPPHQVFTWTQMCDIKDVKVVI

LGQEPYHGPNQAHGLCFSVQRPVPPPPSLENIYKELSTDIEDFVHPGHGD

LSGWAKQGVLLLNAVLTVRAHQANSHKERGWEQFTDAVVSWLNQNSNGLV

FLLWGSYAQKKGSAIDRKRHHVLQTAHPSPLSVYRGFFGCRHFSKTNELL

QKSGKKPIDWKEL
```

In some embodiments, the fusion protein comprises a nuclease-inactive Cas9 domain (e.g., a dCas9 domain or a Cas9n domain) fused to a cytidine deaminase domain, wherein the fusion protein comprises or consists of the amino acid sequence of any one of SEQ ID NOs: 543-550. In some embodiments, the fusion protein comprises or consists of the amino acid sequence of SEQ ID NO: 543. In some embodiments, the fusion protein comprises or consists of the amino acid sequence of SEQ ID NO: 544.

```
BE2 (rAPOBEC1-XTEN-dCas9-UGI)
                                    (SEQ ID NO: 543)
MSSETGPVAVDPTLRRRIEPHEFEVFFDPRELRKETCLLYEINWGGRHSIWRHTSQNTNKHVEVNFIEKETTE

RYFCPNTRCSITWELSWSPCGECSRAITEFLSRYPHVTLFIYIARLYHHADPRNRQGLRDLISSGVTIQIMTE

QESGYCWRNFVNYSPSNEAHWPRYPHLWVRLYVLELYCIILGLPPCLNILRRKQPQLTFFTIALQSCHYQRLP

PHILWATGLKSGSETPGTSESATPESDKKYSIGLAIGTNSVGWAVITDEYKVPSKKFKVLGNTDRHSIKKNLI
```

-continued

GALLFDSGETAEATRLKRTARRRYTRRKNRICYLQEIFSNEMAKVDDSFFHRLEESFLVEEDKKHERHPIFGN
IVDEVAYHEKYPTIYHLRKKLVDSTDKADLRLIYLALAHMIKFRGHFLIEGDLNPDNSDVDKLFIQLVQTYNQ
LFEENPINASGVDAKAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRYDEHHQDLTLLKALVR
QQLPEKYKEIFFDQSKNGYAGYIDGGASQEEFYKFIKPILEKMDGTEELLVKLNREDLLRKQRTFDNGSIPHQ
IHLGELHAILRRQEDFYPFLKDNREKIEKILTFRIPYYVGPLARGNSRFAWMTRKSEETITPWNFEEVVDKGA
SAQSFIERMTNFDKNLPNEKVLPKHSLLYEYFTVYNELTKVKYVTEGMRKPAFLSGEQKKAIVDLLFKTNRKV
TVKQLKEDYFKKIECFDSVEISGVEDRFNASLGTYHDLLKIIKDKDFLDNEENEDILEDIVLTLTLFEDREMI
EERLKTYAHLFDDKVMKQLKRRRYTGWGRLSRKLINGIRDKQSGKTILDFLKSDGFANRNFMQLIHDDSLTFK
EDIQKAQVSGQGDSLHEHIANLAGSPAIKKGILQTVKVVDELVKVMGRHKPENIVIEMARENQTTQKGQKNSR
ERMKRIEEGIKELGSQILKEHPVENTQLQNEKLYLYYLQNGRDMYVDQELDINRLSDYDVDAIVPQSFLKDDS
IDNKVLTRSDKNRGKSDNVPSEEVVKKMKNYWRQLLNAKLITQRKFDNLTKAERGGLSELDKAGFIKRQLVET
RQITKHVAQILDSRMNTKYDENDKLIREVKVITLKSKLVSDFRKDFQFYKVREINNYHHAHDAYLNAVVGTAL
IKKYPKLESEFVYGDYKVYDVRKMIAKSEQEIGKATAKYFFYSNIMNFFKTEITLANGEIRKRPLIETNGETG
EIVWDKGRDFATVRKVLSMPQVNIVKKTEVQTGGFSKESILPKRNSDKLIARKKDWDPKKYGGFDSPTVAYSV
LVVAKVEKGKSKKLKSVKELLGITIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYLDEIIEQISEFSKRVILADANLDK
VLSAYNKHRDKPIREQAENIIHLFTLTNLGAPAAFKYFDTTIDRKRYTSTKEVLDATLIHQSITGLYETRIDL
SQLGGDSGGSTNLSDIIEKETGKQLVIQESILMLPEEVEEVIGNKPESDILVHTAYDESTDENVMLLTSDAPE
YKPWALVIQDSNGENKIKML

BE2 with NLS (rAPOBEC1-XTEN-dCas9-UGI-NLS)
(SEQ ID NO: 550)
MSSETGPVAVDPTLRRRIEPHEFEVFFDPRELRKETCLLYEINWGGRHSIWRHTSQNTNKHVEVNFIEKF
TTERYFCPNTRCSITWFLSWSPCGECSRAITEFLSRYPHVTLFIYIARLYHHADPRNRQGLRDLISSGVTIQ
IMTEQESGYCWRNFVNYSPSNEAHWPRYPHLWVRLYVLELYCIILGLPPCLNILRRKQPQLTFFTIALQSC
HYQRLPPHILWATGLKSGSETPGTSESATPESDKKYSIGLAIGTNSVGWAVITDEYKVPSKKFKVLGNTDR
HSIKKNLIGALLFDSGETAEATRLKRTARRRYTRRKNRICYLQEIFSNEMAKVDDSFFHRLEESFLVEEDKK
HERHPIFGNIVDEVAYHEKYPTIYHLRKKLVDSTDKADLRLIYLALAHMIKFRGHFLIEGDLNPDNSDVDKLF
IQLVQTYNQLFEENPINASGVDAKAILSARLSKSRRLENLIAQLPGEKKNGLFGNLIALSLGLTPNFKSNFDL
AEDAKLQLSKDTYDDDLDNLLAQIGDQYADLFLAAKNILSDAILLSDILRVNTEITKAPLSASMIKRYDEHHQ
DLTLLKALVRQQLPEKYKEIFFDQSKNGYAGYIDGGASQEEFYKFIKPILEKMDGTEELLVKLNREDLLRKQ
RTFDNGSIPHQIHLGELHAILRRQEDFYPFLKDNREKIEKILTFRIPYYVGPLARGNSRFAWMTRKSEETITP
WNFEEVVDKFASAQSFIERMTNFDKNLPNEKVLPKHSLLYEFTVYNELTKVKYVTEGMRKPAFLSGEQ
KKAIVDLLFKTNRKVTVKQLKEDYFKKIECFSDVEISGVEDRFNASLGTYHDLLKIIKDKDFLDNEENEDILE
DIVLTLTLFEDREMIEERLKTYAHLFDDKVMKQLKRRRYTGWGRLSRKLINGIRDKQSGKTILDFLKSDGFA
NRNFMQLIHDDSLTFKEDIQKAQVSGQGDSLHEHIANLAGSPAIKKGILQTVKVVDELVKVMGRHKPENIVI
EMARENQTTQKGQKNSRERMKRIEEGIKELGSQILKEHPVENTQLQNEKLYLYYLQNGRDMYVDQELDI
NRLSDYDVDAIVPQSFLKDDSIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLIREVKVITLKSKLVSDFRKDFQF
YKVREINNYHHAHDAYLNAVVGTALIKKYPKLESEFVYGDYKVYDVRKMIAKSEQEIGKATAKYFFYSNIM
NFFKTEITLANGEIRKRPLIETNGETGEIVWDKGRDFATVRKVLSMPQVINVKKTEVQTGGFSKESILPKRN

```
SDKLIARKKDWDPKKYGGFDSPTVAYSVLVVAKVEKGKSKKLKSVKELLGITIMERSSFEKNPIDFLEAKG

YKEVKKDLIIKLPKYSLFELENRKRMLASAGELQKGNELALPSKYVNFLYLASHYEKLKGSPEDNEQKQL

FVEQHKHYLDEIIEQISEFSKRVILADANLDKVLSAYNKHRDKPIREQAENIIHLFTLTNLGAPAAFKYFDTTI

DRKRYTSTKEVLDATLIHQSITGLYETRIDLSQLGGDSGGSTNLSDIIEKETGKQLVIQESILMLPEEVEEVIG

DRKRYTSTKEVLDATLIHQSITGLYETRIDLSQLGGDSGGSTNLSDIIEKETGKQLVIQESILMLPEEVEEVIG

NKPEDSILVHTAYDESTDENVMLLTSDAPEYKPWALVIQDSNGENKIKMLSGGSPKKKRKV
```

BE3 (rAPOBEC1-XTEN-Cas9n-UGI-NLS)

(SEQ ID NO: 544)

```
MSSETGPVAVDPTLRRRIEPHEFEVFFDPRELRKETCLLYEINWGGRHSIWRHTSQNTNKHVEVNFIEKF

TTERYFCPNTRCSITWFLSWSPCGECSRAITEFLSRYPHVTLFIYIARLYHHADPRNRQGLRDLISSGVTIQ

IMTEQESGYCWRNFVNYSPSNEAHWPRYPHLWVRLYVLELYCIILGLPPCLNILRRKQPQLTFFTIALQSC

HYQRLPPHILWATGLKSGSETPGTSESATPESDKKYSIGLAIGTNSVGWAVITDEYKVPSKKFKVLGNTDR

HSIKKNLIGALLFDSGETAEATRLKRTARRRYTRRKNRICYLQEIFSNEMAKVDDSFFHRLEESFLVEEDKK

HERHPIFGNIVDEVAYHEKYPTIYHLRKKLVDSTDKADLRLIYLALAHMIKFRGHFLIEGDLNPDNSDVDKLF

IQLVQTYNQLFEENPINASGVDAKAILSARLSKSRRLENLIAQLPGEKKNGLFGNLIALSLGLTPNFKSNFDL

AEDAKLQLSKDTYDDDLDNLLAQIGDQYADLFLAAKNILSDAILLSDILRVNTEITKAPLSASMIKRYDEHHQ

DLTLLKALVRQQLPEKYKEIFFDQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYVGPLARGNSRFAWMTRKSEETITP

WNFEEVVDKFASAQSFIERMTNFDKNLPNEKVLPKHSLLYEFTVYNELTKVKYVTEGMRKPAFLSGEQ

KKAIVDLLFKTNRKVTVKQLKEDYFKKIECFSDVEISGVEDRFNASLGTYHDLLKIIKDKDFLDNEENEDILE

DIVLTLTLFEDREMIEERLKTYAHLFDDKVMKQLRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKMGRHKPENIVI

EMARENQTTQKGQKNSRERMKRIEEGIKELGSQILKEHPVENTQLQNEKLYLYYLQNGRDMYVDQELDI

NRLSDYDVDAIVPQSFLKDDSIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLIREVKVITLKSKLVSDFRKDFQF

YKVREINNYHHAHDAYLNAVVGTALIKKYPKLESEFVYGDYKVYDVRKMIAKSEQEIGKATAKYFFYSNIM

NFFKTEITLANGEIRKRPLIETNGETGEIVWDKGRDFATVRKVLSMPQVINVKKTEVQTGGFSKESILPKRN

SDKLIARKKDWDPKKYGGFDSPTVAYSVLVVAKVEKGKSKKLKSVKELLGITIMERSSFEKNPIDFLEAKG

YKEVKKDLIIKLPKYSLFELENRKRMLASAGELQKGNELALPSKYVNFLYLASHYEKLKGSPEDNEQKQL

FVEQHKHYLDEIIEQISEFSKRVILADANLDKVLSAYNKHRDKPIREQAENIIHLFTLTNLGAPAAFKYFDTTI

DRKRYTSTKEVLDATLIHQSITGLYETRIDLSQLGGDSGGSTNLSDIIEKETGKQLVIQESILMLPEEVEEVIG

DRKRYTSTKEVLDATLIHQSITGLYETRIDLSQLGGDSGGSTNLSDIIEKETGKQLVIQESILMLPEEVEEVIG

NKPEDSILVHTAYDESTDENVMLLTSDAPEYKPWALVIQDSNGENKIKMLSGGSPKKKRKV
``` pmCDA1-XTEN-dCas9-UGI (bacteria)

(SEQ ID NO: 545)

```
MTDAEYVRIHEKLDIYTFKKQFFNNKKSVSHRCYVLFELKRRGERRACFWGYAVNKPQSGTERGIHAEIFSIR

KVEEYLRDNPGQFTINWYSSWSPCADCAEKILEWYNQELRGNGHTLKIWACKLYYEKNARNQIGLWNLRDNGV

GLNVMVSEHYQCCRKIFIQSSHNQLNENRWLEKTLKRAEKRRSELSIMIQVKILHTTKSPAVSGSETPGTSES

ATPESDKKYSIGLAIGTNSVGWAVITDEYKVPSKKEKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLRKKL

VDSTDKADLRLIYLALAHMIKFRGHFLIEGDLNPDNSDVDKLFIQLVQTYNQLFEENPINASGVDAKAILSAR

LSKSRRLENLIAQLPGEKKNGLFGNLIALSLGLTPNEKSNEDLAEDAKLQLSKDTYDDDLDNLLAQIGDQYAD

LFLAAKNLSDAILLSDILRVNTEITKAPLSASMIKRYDEHHQDLTLLKALVRQQLPEKYKEIFFDQSKNGYAG
```

-continued

YlDGGASQEEFYKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMTNEDKNLPNEKV

LPKHSLLYEYFTVYNELTKVKYVTEGMRKPAELSGEQKKAIVDLLEKTNRKVTVKQLKEDYFKKIECEDSVEI

SGVEDRFNASLGTYHDLLKIIKDKDFLDNEENEDILEDIVLTLTLFEDREMIEERLKTYAHLFDDKVMKQLKR

RRYTGWGRLSRKLINGIRDKQSGKTILDFLKSDGFANRNFMQLIHDDSLTFKEDIQKAQVSGQGDSLHEHIAN

LAGSPAIKKGILQTVKVVDELVKVMGRHKPENIVIEMARENQTTQKGQKNSRERMKRIEEGIKELGSQILKEH

PVENTQLQNEKLYLYYLQNGRDMYVDQELDINRLSDYDVDAIVPQSFLKDDSIDNKVLTRSDKNRGKSDNVPS

EEVVKKMKNYWRQLLNAKLITQRKEDNLTKAERGGLSELDKAGFIKRQLVETRQITKHVAQILDSRMNTKYDE

NDKLIREVKVITLKSKLVSDERKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFATVRKVLSMPQ

VNIVKKTEVQTGGFSKESILPKRNSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRMLASAGELQKGNELALPSKYVNFLY

LASHYEKLKGSPEDNEQKQLFVEQHKHYLDEIIEQISEFSKRVILADANLDKVLSAYNKHRDKPIREQAENII

HLFTLTNLGAPAAFKYFDTTIDRKRYTSTKEVLDATLIHQSITGLYETRIDLSQLGGDSGGSMTNLSDIIEKE

TGKQLVIQESILMLPEEVEEVIGNKPESDILVHTAYDESTDENVMLLTSDAPEYKPWALVIQDSNGENKIKML pmCDA1-XTEN-nCas9-UGI-NLS (mammalian construct)

(SEQ ID NO: 546)

MTDAEYVRIHEKLDIYTFKKQFFNNKKSVSHRCYVLFELKRRGERRACFWGYAVNKPQSGTERGIHAEIFSIR

KVEEYLRDNPGQFTINWYSSWSPCADCAEKILEWYNQELRGNGHTLKIWACKLYYEKNARNQIGLWNLRDNGV

GLNVMVSEHYQCCRKIFIQSSHNQLNENRWLEKTLKRAEKRRSELSIMIQVKILHTTKSPAVSGSETPGTSES

ATPESDKKYSIGLAIGTNSVGWAVITDEYKVPSKKEKVLGNTDRHSIKKNLIGALLFDSGETAEATRLKRTAR

RRYTRRKNRICYLQEIFSNEMAKVDDSFFHRLEESFLVEEDKKHERHPIFGNIVDEVAYHEKYPTIYHLRKKL

VDSTDKADLRLIYLALAHMIKFRGHFLIEGDLNPDNSDVDKLFIQLVQTYNQLFEENPINASGVDAKAILSAR

LSKSRRLENLIAQLPGEKKNGLFGNLIALSLGLTPNFKSNFDLAEDAKLQLSKDTYDDDLDNLLAQIGDQYAD

LFLAAKNLSDAILLSDILRVNTEITKAPLSASMIKRYDEHHQDLTLLKALVRQQLPEKYKEIFFDQSKNGYAG

YIDGGASQEEFYKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMTNEDKNLPNEKV

LPKHSLLYEYFTVYNELTKVKYVTEGMRKPAELSGEQKKAIVDLLEKTNRKVTVKQLKEDYFKKIECEDSVEI

SGVEDRFNASLGTYHDLLKIIKDKDFLDNEENEDILEDIVLTLTLFEDREMIEERLKTYAHLFDDKVMKQLKR

RRYTGWGRLSRKLINGIRDKQSGKTILDFLKSDGFANRNFMQLIHDDSLTFKEDIQKAQVSGQGDSLHEHIAN

LAGSPAIKKGILQTVKVVDELVKVMGRHKPENIVIEMARENQTTQKGQKNSRERMKRIEEGIKELGSQILKEH

PVENTQLQNEKLYLYYLQNGRDMYVDQELDINRLSDYDVDHIVPQSFLKDDSIDNKVLTRSDKNRGKSDNVPS

EEVVKKMKNYWRQLLNAKLITQRKEDNLTKAERGGLSELDKAGFIKRQLVETRQITKHVAQILDSRMNTKYDE

NDKLIREVKVITLKSKLVSDERKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFATVRKVLSMPQ

VNIVKKTEVQTGGFSKESILPKRNSDKLIARKKDWDPKKYGGFDSPTVAYSVLVVAKVEKGKSKKLKSVKELL

GITIMERSSFEKNPIDFLEAKGYKEVKKDLIIKLPKYSLFELENGRKRMLASAGELQKGNELALPSKYVNFLY

LASHYEKLKGSPEDNEQKQLFVEQHKHYLDEIIEQISEFSKRVILADANLDKVLSAYNKHRDKPIREQAENII

HLFTLTNLGAPAAFKYFDTTIDRKRYTSTKEVLDATLIHQSITGLYETRIDLSQLGGDSGGSTNLSDIIEKET

GKQLVIQESILMLPEEVEEVIGNKPESDILVHTAYDESTDENVMLLTSDAPEYKPWALVIQDSNGENKIKMLS

GGSPKKKRKV

-continued huAPOBEC3G-XTEN-dCas9-UGI (bacteria)

(SEQ ID NO: 547)

MDPPTFTFNENNEPWVRGRHETYLCYEVERMHNDTWVLLNQRRGELCNQAPHKHGELEGRHAELCFLDVIPFW

KLDLDQDYRVICETSWSPCFSCAQEMAKFISKNKHVSLCIFTARIYDDQGRCQEGLRTLAEAGAKISIMTYSE

FKHCWDTFVDHQGCPFQPWDGLDEHSQDLSGRLRAILQSGSETPGTSESATPESDKKYSIGLAIGTNSVGWAV

ITDEYKVPSKKEKVLGNTDRHSIKKNLIGALLFDSGETAEATRLKRTARRRYTRRKNRICYLQEIFSNEMAKV

DDSFFHRLEESFLVEEDKKHERHPIFGNIVDEVAYHEKYPTIYHLRKKLVDSTDKADLRLIYLALAHMIKFRG

HFLIEGDLNPDNSDVDKLFIQLVQTYNQLFEENPINASGVDAKAILSARLSKSRRLENLIAQLPGEKKNGLFG

NLIALSLGLTPNEKSNFDLAEDAKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYIDGGASQEEFYKFIKPILEKMDG

TEELLVKLNREDLLRKQRTFDNGSIPHQIHLGELHAILRRQEDFYPFLKDNREKIEKILTFRIPYYVGPLARG

NSRFAWMTRKSEETITPWNFEEVVDKGASAQSFIERMTNEDKNLPNEKVLPKHSLLYEYFTVYNELTKVKYVT

EGMRKPAELSGEQKKAIVDLLEKTNRKVTVKQLKEDYFKKIECFDSVEISGVEDRFNASLGTYHDLLKIIKDK

DELDNEENEDILEDIVILTLFEDREMIEERLKTYAHLFDDKVMKQLKRRRYTGWGRLSRKLINGIRDKQSGK

TILDFLKSDGFANRNFMQLIHDDSLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHPVENTQLQNEKLYLYYLQNGRDMY

VDQELDINRLSDYDVDAIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRKMIAKSEQEIGKATAKYFFYSNI

MNFFKTEITLANGEIRKRPLIETNGETGEIVWDKGRDFATVRKVLSMPQVNIVKKTEVQTGGFSKESILPKRN

SDKLIARKKDWDPKKYGGFDSPTVAYSVLVVAKVEKGKSKKLKSVKELLGITIMERSSFEKNPIDFLEAKGYK

EVKKDLIIKLPKYSLFELENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGAPAAFKYFDTTIDRK

RYTSTKEVLDATLIHQSITGLYETRIDLSQLGGDSGGSMTNLSDIIEKETGKQLVIQESILMLPEEVEEVIGN

KPESDILVHTAYDESTDENVMLLTSDAPEYKPWALVIQDSNGENKIKML huAPOBEC3G-XTEN-nCas9-UGI-NLS (mammalian construct)

(SEQ ID NO: 548)

MDPPTFTFNENNEPWVRGRHETYLCYEVERMHNDTWVLLNQRRGELCNQAPHKHGELEGRHAELCFLDVIPFW

KLDLDQDYRVICETSWSPCFSCAQEMAKFISKNKHVSLCIFTARIYDDQGRCQEGLRTLAEAGAKISIMTYSE

FKHCWDTFVDHQGCPFQPWDGLDEHSQDLSGRLRAILQSGSETPGTSESATPESDKKYSIGLAIGTNSVGWAV

ITDEYKVPSKKEKVLGNTDRHSIKKNLIGALLFDSGETAEATRLKRTARRRYTRRKNRICYLQEIFSNEMAKV

DDSFFHRLEESFLVEEDKKHERHPIFGNIVDEVAYHEKYPTIYHLRKKLVDSTDKADLRLIYLALAHMIKFRG

HFLIEGDLNPDNSDVDKLFIQLVQTYNQLFEENPINASGVDAKAILSARLSKSRRLENLIAQLPGEKKNGLFG

NLIALSLGLTPNEKSNFDLAEDAKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYIDGGASQEEFYKFIKPILEKMDG

TEELLVKLNREDLLRKQRTFDNGSIPHQIHLGELHAILRRQEDFYPFLKDNREKIEKILTFRIPYYVGPLARG

NSRFAWMTRKSEETITPWNFEEVVDKGASAQSFIERMTNEDKNLPNEKVLPKHSLLYEYFTVYNELTKVKYVT

EGMRKPAELSGEQKKAIVDLLEKTNRKVTVKQLKEDYFKKIECFDSVEISGVEDRFNASLGTYHDLLKIIKDK

DELDNEENEDILEDIVILTLFEDREMIEERLKTYAHLFDDKVMKQLKRRRYTGWGRLSRKLINGIRDKQSGK

TILDFLKSDGFANRNFMQLIHDDSLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHPVENTQLQNEKLYLYYLQNGRDMY

VDQELDINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSDFRKD

```
FQFYKVREINNYHHAHDAYLNAVVGTALIKKYPKLESEFVYGDYKVYDVRKMIAKSEQEIGKATAKYFFYSNI

MNFEKTEITLANGEIRKRPLIETNGETGEIVWDKGRDFATVRKVLSMPQVNIVKKTEVQTGGFSKESILPKRN

SDKLIARKKDWDPKKYGGFDSPTVAYSVLVVAKVEKGKSKKLKSVKELLGITIMERSSFEKNPIDFLEAKGYK

EVKKDLIIKLPKYSLFELENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGAPAAFKYFDTTIDRK

RYTSTKEVLDATLIHQSITGLYETRIDLSQLGGDSGGSTNLSDIIEKETGKQLVIQESILMLPEEVEEVIGNK

PESDILVHTAYDESTDENVMLLTSDAPEYKPWALVIQDSNGENKIKMLSGGSPKKKRKV huAPOBEC3G (D316R_D317R)-XTEN-nCas9-UGI-NLS (mammalian construct)
                                                 (SEQ ID NO: 549)
MDPPTFTFNENNEPWVRGRHETYLCYEVERMHNDTWVLLNQRRGELCNQAPHKHGELEGRHAELCFLDVIPFW

KLDLDQDYRVICETSWSPCFSCAQEMAKFISKNKHVSLCIFTARIYRRQGRCQEGLRTLAEAGAKISIMTYSE

FKHCWDTFVDHQGCPFQPWDGLDEHSQDLSGRLRAILQSGSETPGTSESATPESDKKYSIGLAIGTNSVGWAV

ITDEYKVPSKKEKVLGNTDRHSIKKNLIGALLFDSGETAEATRLKRTARRRYTRRKNRICYLQEIFSNEMAKV

DDSFFHRLEESFLVEEDKKHERHPIFGNIVDEVAYHEKYPTIYHLRKKLVDSTDKADLRLIYLALAHMIKFRG

HFLIEGDLNPDNSDVDKLFIQLVQTYNQLFEENPINASGVDAKAILSARLSKSRRLENLIAQLPGEKKNGLFG

NLIALSLGLIPNEKSNEDLAEDAKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYIDGGASQEEFYKFIKPILEKMDG

TEELLVKLNREDLLRKQRTFDNGSIPHQIHLGELHAILRRQEDFYPFLKDNREKIEKILTFRIPYYVGPLARG

NSRFAWMTRKSEETITPWNFEEVVDKGASAQSFIERMTNEDKNLPNEKVLPKHSLLYEYFTVYNELTKVKYVT

EGMRKPAELSGEQKKAIVDLLFKTNRKVTVKQLKEDYFKKIECEDSVEISGVEDRFNASLGTYHDLLKIIKDK

DELDNEENEDILEDIVLILTLFEDREMIEERLKTYAHLFDDKVMKQLKRRRYTGWGRLSRKLINGIRDKQSGK

TILDFLKSDGFANRNFMQLIHDDSLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHPVENTQLQNEKLYLYYLQNGRDMY

VDQELDINRLSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRKMIAKSEQEIGKATAKYFFYSNI

MNFEKTEITLANGEIRKRPLIETNGETGEIVWDKGRDFATVRKVLSMPQVNIVKKTEVQTGGFSKESILPKRN

SDKLIARKKDWDPKKYGGFDSPTVAYSVLVVAKVEKGKSKKLKSVKELLGITIMERSSFEKNPIDFLEAKGYK

EVKKDLIIKLPKYSLFELENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGAPAAFKYFDTTIDRK

RYTSTKEVLDATLIHQSITGLYETRIDLSQLGGDSGGSTNLSDIIEKETGKQLVIQESILMLPEEVEEVIGNK

PESDILVHTAYDESTDENVMLLTSDAPEYKPWALVIQDSNGENKIKMLSGGSPKKKRKV
```

Some aspects of the disclosure provide fusion proteins comprising a nucleic acid programmable DNA binding protein (napDNAbp) and an adenosine deaminase. In some embodiments, any of the fusion proteins provided herein are base editors. Some aspects of the disclosure provide fusion proteins comprising a Cas9 domain and an adenosine deaminase. The Cas9 domain may be any of the Cas9 domains (e.g., a dCas9 domain or Cas9n domain) provided herein. In some embodiments, any of the Cas9 domains (e.g., a dCas9 domain or Cas9n domain) provided herein may be fused with any of the adenosine deaminases provided herein. In some embodiments, the fusion protein comprises the structure:

NH$_2$-[adenosine deaminase]-[napDNAbp]-COOH; or
NH$_2$-[napDNAbp]-[adenosine deaminase]-COOH.

In some embodiments, the fusion proteins comprising an adenosine deaminase and a napDNAbp (e.g., Cas9 domain) do not include a linker sequence. In some embodiments, a linker is present between the adenosine deaminase domain and the napDNAbp. In some embodiments, the "-" used in the general architecture above indicates the presence of an optional linker. In some embodiments, the adenosine deaminase and the napDNAbp are fused via any of the linkers provided herein. For example, in some embodiments the adenosine deaminase and the napDNAbp are fused via any of the linkers provided below. In some embodiments, the linker comprises the amino acid sequence of any one of SEQ ID NOs: 300-318. In some embodiments, the adenosine deaminase and the napDNAbp are fused via a linker that comprises between 1 and 200 amino acids. In some embodiments, the adenosine deaminase and the napDNAbp are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the adenosine deaminase and the napDNAbp are fused via a linker that comprises 3, 4, 16, 24, 32, 64, 100, or 104 amino acids in length. In some embodiments, the adenosine deaminase and the napDNAbp are fused via a linker that comprises the amino acid sequence SGSETPGT-SESATPES (SEQ ID NO: 306), SGGSSGGSSGSETPGT-SESATPESSGGSSGGS (SEQ ID NO: 310), or GGSGGSPGSPAGSPTSTEEGTSESATPESGPGT-STEPSEGSAPGSPAGSPTSTEEGTSTEPS EGSAPGT-STEPSEGSAPGTSESATPESGPGSEPATSGGSGGS (SEQ ID NO: 314). In some embodiments, the adenosine deaminase and the napDNAbp are fused via a linker comprising the amino acid sequence SGSETPGTSESATPES (SEQ ID NO: 306), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 315). In some embodiments, the linker is 32 amino acids in length. In some embodiments, the linker comprises the amino acid sequence (SGGS)$_2$-SGSETPGTSESATPES-(SGGS)$_2$ (SEQ ID NO: 308), which may also be referred to as (SGGS)$_2$-XTEN-(SGGS)$_2$. In some embodiments, the linker comprises the amino acid sequence (SGGS)$_n$-SG-SETPGTSESATPES-(SGGS)$_n$ (SEQ ID NO: 310), wherein n is 0, 1, 2, 3, 4, 5, 6, 7, 8, 9, or 10. In some embodiments, the linker is 40 amino acids in length. In some embodiments, the linker comprises the amino acid sequence SGGSSGGSSGSETPGTSESAT-PESSGGSSGGSSGGSSGGS (SEQ ID NO: 316). In some embodiments, the linker is 64 amino acids in length. In some embodiments, the linker comprises the amino acid sequence SGGSSGGSSGSETPGTSESAT-PESSGGSSGGSSGGSSGGSSGGSSGSETPGTSESAT-PESSGGSS GGS (SEQ ID NO: 317). In some embodiments, the linker is 92 amino acids in length. In some embodiments, the linker comprises the amino acid sequence (SEQ ID NO: 318)
PGSPAGSPTSTEEGTSESATPESGPGTSTEPSEGSAPGSPAGSPT-
STEEGTS
TEPSEGSAPGTSTEPSEGSAPGTSESATPESGPGSEPATS.

In some embodiments, the fusion proteins comprising an adenosine deaminase provided herein further comprise one or more nuclear targeting sequences, for example, a nuclear localization sequence (NLS). In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the IBR (e.g., dISN). In some embodiments, the NLS is fused to the C-terminus of the IBR (e.g., dISN). In some embodiments, the NLS is fused to the N-terminus of the napDNAbp. In some embodiments, the NLS is fused to the C-terminus of the napDNAbp. In some embodiments, the NLS is fused to the N-terminus of the adenosine deaminase. In some embodiments, the NLS is fused to the C-terminus of the adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 520 or SEQ ID NO: 521. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 520). In some embodiments, a NLS comprises the amino acid sequence MDSLLMNRRKFLYQFKNVR-WAKGRRETYLC (SEQ ID NO: 521).

In some embodiments, the general architecture of exemplary fusion proteins with an adenosine deaminase and a napDNAbp comprises any one of the following structures, where NLS is a nuclear localization sequence (e.g., any NLS provided herein), NH$_2$ is the N-terminus of the fusion protein, and COOH is the C-terminus of the fusion protein. Fusion proteins comprising an adenosine deaminase, a napDNAbp, and a NLS:

NH$_2$-[NLS]-[adenosine deaminase]-[napDNAbp]-COOH;
NH$_2$-[adenosine deaminase]-[NLS]-[napDNAbp]-COOH;
NH$_2$-[adenosine deaminase]-[napDNAbp]-[NLS]-COOH;
NH$_2$-[NLS]-[napDNAbp]-[adenosine deaminase]-COOH;
NH$_2$-[napDNAbp]-[NLS]-[adenosine deaminase]-COOH; and
NH$_2$-[napDNAbp]-[adenosine deaminase]-[NLS]-COOH.

In some embodiments, the fusion proteins comprising an adenosine deaminase domain provided herein do not comprise a linker. In some embodiments, a linker is present between one or more of the domains or proteins (e.g., adenosine deaminase, napDNAbp, and/or NLS). In some embodiments, the "-" used in the general architecture above indicates the presence of an optional linker.

Some aspects of the disclosure provide fusion proteins that comprise a nucleic acid programmable DNA binding protein (napDNAbp) and at least two adenosine deaminase domains. Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminase domains. In some embodiments, any of the fusion proteins provided herein comprise two adenosine deaminases. In some embodiments, any of the fusion proteins provided herein contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine is any of the adenosine deaminases provided herein, but is not identical to the first adenosine deaminase. As one example, the fusion protein may comprise a first adenosine deaminase and a second adenosine deaminase that both comprise the amino acid sequence of SEQ ID NO: 417, which contains a A106V, D108N, D147Y, and E155V mutation from ecTadA (SEQ ID NO: 400). In some embodiments, the fusion protein may comprise a first adenosine deaminase that comprises the amino acid sequence of SEQ ID NO: 452, which contains a H36L, P48S, R51L, L84F, A106V, D108N, H123Y, S146C, D147Y, E155V, I156F, and K157N mutation from SEQ ID NO: 400, and a second adenosine deaminase domain that comprises the amino acid sequence of wild-type ecTadA (SEQ ID NO: 400). In some embodiments, the fusion protein may comprise a first adenosine deaminase that comprises the amino acid sequence of SEQ ID NO: 455, which contains a H36L, P48S, R51L, L84F, A106V, D108N, H123Y, A142N, S146C, D147Y, E155V, I156F, and K157N mutation from SEQ ID NO: 400, and a second adenosine deaminase domain that comprises the amino acid sequence of wild-type ecTadA (SEQ ID NO: 400). In some embodiments, the fusion protein may comprise a first adenosine deaminase that comprises the amino acid sequence of SEQ ID NO: 456, which contains a W23L, H36L, P48A, R51L, L84F, A106V, D108N, H123Y, A142N, S146C, D147Y, E155V, I156F, and K157N mutation from SEQ ID NO: 400, and a second adenosine deaminase domain that comprises the amino acid sequence of wild-type ecTadA (SEQ ID NO: 400). In some embodiments, the fusion protein may comprise a first adenosine deaminase that comprises the amino acid sequence of SEQ ID NO: 457, which contains a W23L, H36L, P48A, R51L, L84F, A106V, D108N, H123Y, A142N, S146C, D147Y, R152P, E155V, I156F, and K157N mutation from SEQ ID NO: 400, and a second adenosine deaminase domain that comprises the amino acid sequence of wild-type ecTadA (SEQ ID NO: 400). In some embodiments, the fusion protein may comprise a first adenosine deaminase that comprises the amino acid sequence of SEQ ID NO: 458, which contains a W23R, H36L, P48A, R51L, L84F, A106V, D108N, H123Y, S146C, D147Y, R152P, E155V, I156F, and K157N mutation from SEQ ID NO: 400, and a second adenosine deaminase domain that comprises the amino acid sequence of wild-type ecTadA (SEQ ID NO: 400). Additional fusion protein constructs comprising two adenosine deaminase domains suitable for use herein are illustrated in Gaudelli N M, et al. (2017) Programmable base editing of A·T to G·C in genomic DNA without DNA cleavage, Nature, 551(23); 464-471; the entire contents of which is incorporated herein by reference.

In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker. In some embodiments, the linker is any of the linkers provided herein. In some embodiments, the linker comprises the amino acid sequence of any one of SEQ ID NOs: 300-318. In some embodiments, the linker is 32 amino acids in length. In some embodiments, the linker comprises the amino acid sequence $(SGGS)_2$-SGSETPGTSESATPES-$(SGGS)_2$ (SEQ ID NO: 308), which may also be referred to as $(SGGS)_2$-XTEN-$(SGGS)_2$. In some embodiments, the linker comprises the amino acid sequence $(SGGS)_n$-SGSETPGTSESATPES-$(SGGS)_n$ (SEQ ID NO: 310), wherein n is 0, 1, 2, 3, 4, 5, 6, 7, 8, 9, or 10. In some embodiments, the first adenosine deaminase is the same as the second adenosine deaminase. In some embodiments, the first adenosine deaminase and the second adenosine deaminase are any of the adenosine deaminases described herein. In some embodiments, the first adenosine deaminase and the second adenosine deaminase are different. In some embodiments, the first adenosine deaminase is any of the adenosine deaminases provided herein. In some embodiments, the second adenosine deaminase is any of the adenosine deaminases provided herein but is not identical to the first adenosine deaminase. In some embodiments, the first adenosine deaminase is an ecTadA adenosine deaminase. In some embodiments, the first adenosine deaminase comprises an amino acid sequence that is at least least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 400-458, or to any of the adenosine deaminases provided herein. In some embodiments, the first adenosine deaminase comprises the amino acid sequence of SEQ ID NO: 400. In some embodiments, the second adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 400-458, or to any of the adenosine deaminases provided herein. In some embodiments, the second adenosine deaminase comprises the amino acid sequence of SEQ ID NO: 400. In some embodiments, the first adenosine deaminase and the second adenosine deaminase of the fusion protein comprise the mutations in ecTadA (SEQ ID NO: 400), or corresponding mutations in another adenosine deaminase, such as the amino acid sequences of any one of SEQ ID NOs: 402-408. In some embodiments, the fusion protein comprises the two adenosine deaminases (e.g., a first adenosine deaminase and a second adenosine deaminase) of any one of SEQ ID NOs: 400-458.

In some embodiments, the general architecture of exemplary fusion proteins with a first adenosine deaminase, a second adenosine deaminase, and a napDNAbp comprises any one of the following structures, where NLS is a nuclear localization sequence (e.g., any NLS provided herein), $NH_2$ is the N-terminus of the fusion protein, and COOH is the C-terminus of the fusion protein:

$NH_2$-[first adenosine deaminase]-[second adenosine deaminase]-[napDNAbp]-COOH;

$NH_2$-[first adenosine deaminase]-[napDNAbp]-[second adenosine deaminase]-COOH;

$NH_2$-[napDNAbp]-[first adenosine deaminase]-[second adenosine deaminase]-COOH;

$NH_2$-[second adenosine deaminase]-[first adenosine deaminase]-[napDNAbp]-COOH;

$NH_2$-[second adenosine deaminase]-[napDNAbp]-[first adenosine deaminase]-COOH;

$NH_2$-[napDNAbp]-[second adenosine deaminase]-[first adenosine deaminase]-COOH;

In some embodiments, the fusion proteins provided herein do not comprise a linker. In some embodiments, a linker is present between one or more of the domains or proteins (e.g., first adenosine deaminase, second adenosine deaminase, and/or napDNAbp). In some embodiments, the "-" used in the general architecture above indicates the presence of an optional linker.

In some embodiments, a fusion protein comprising a first adenosine deaminase, a second adenosine deaminase, and a napDNAbp further comprise a NLS. Exemplary fusion proteins comprising a first adenosine deaminase, a second adenosine deaminase, a napDNAbp, and an NLS are shown as follows:

NH$_2$-[NLS]-[first adenosine deaminase]-[second adenosine deaminase]-[napDNAbp]-COOH;
NH$_2$-[first adenosine deaminase]-[NLS]-[second adenosine deaminase]-[napDNAbp]-COOH;
NH$_2$-[first adenosine deaminase]-[second adenosine deaminase]-[NLS]-[napDNAbp]-COOH;
NH$_2$-[first adenosine deaminase]-[second adenosine deaminase]-[napDNAbp]-[NLS]-COOH;
NH$_2$-[NLS]-[first adenosine deaminase]-[napDNAbp]-[second adenosine deaminase]-COOH;
NH$_2$-[first adenosine deaminase]-[NLS]-[napDNAbp]-[second adenosine deaminase]-COOH;
NH$_2$-[first adenosine deaminase]-[napDNAbp]-[NLS]-[second adenosine deaminase]-COOH;
NH$_2$-[first adenosine deaminase]-[napDNAbp]-[second adenosine deaminase]-[NLS]-COOH;
NH$_2$-[NLS]-[napDNAbp]-[first adenosine deaminase]-[second adenosine deaminase]-COOH;
NH$_2$-[napDNAbp]-[NLS]-[first adenosine deaminase]-[second adenosine deaminase]-COOH;
NH$_2$-[napDNAbp]-[first adenosine deaminase]-[NLS]-[second adenosine deaminase]-COOH;
NH$_2$-[napDNAbp]-[first adenosine deaminase]-[second adenosine deaminase]-[NLS]-COOH;
NH$_2$-[NLS]-[second adenosine deaminase]-[first adenosine deaminase]-[napDNAbp]-COOH;
NH$_2$-[second adenosine deaminase]-[NLS]-[first adenosine deaminase]-[napDNAbp]-COOH;
NH$_2$-[second adenosine deaminase]-[first adenosine deaminase]-[NLS]-[napDNAbp]-COOH;
NH$_2$-[second adenosine deaminase]-[first adenosine deaminase]-[napDNAbp]-[NLS]-COOH;
NH$_2$-[NLS]-[second adenosine deaminase]-[napDNAbp]-[first adenosine deaminase]-COOH;
NH$_2$-[second adenosine deaminase]-[NLS]-[napDNAbp]-[first adenosine deaminase]-COOH;
NH$_2$-[second adenosine deaminase]-[napDNAbp]-[NLS]-[first adenosine deaminase]-COOH;
NH$_2$-[second adenosine deaminase]-[napDNAbp]-[first adenosine deaminase]-[NLS]-COOH;
NH$_2$-[NLS]-[napDNAbp]-[second adenosine deaminase]-[first adenosine deaminase]-COOH;
NH$_2$-[napDNAbp]-[NLS]-[second adenosine deaminase]-[first adenosine deaminase]-COOH;
NH$_2$-[napDNAbp]-[second adenosine deaminase]-[NLS]-[first adenosine deaminase]-COOH;
NH$_2$-[napDNAbp]-[second adenosine deaminase]-[first adenosine deaminase]-[NLS]-COOH;

In some embodiments, the fusion proteins provided herein do not comprise a linker. In some embodiments, a linker is present between one or more of the domains or proteins (e.g., first adenosine deaminase, second adenosine deaminase, napDNAbp, and/or NLS). In some embodiments, the "-" used in the general architecture above indicates the presence of an optional linker.

In some embodiments, the fusion protein comprises a nuclease-inactive Cas9 domain (e.g., a dCas9 domain or a Cas9n domain) and one or more adenosine deaminase domains (e.g., a first adenosine deaminase and a second adenosine deaminase). In some embodiments, a nuclease-inactive Cas9 domain (e.g., a dCas9 domain or a Cas9n domain), comprises an amino acid sequence that is at least 80%, at least 85%, at least 90%, at least 92%, at least 95%, at least 96%, at least 97%, at least 98%, at least 99%, or at least 99.5% identical to the amino acid sequence of a Cas9 as provided by any one of SEQ ID NOs: 10-260, and comprises mutations that inactivate the nuclease activity of Cas9. Mutations that render the nuclease domains of Cas9 inactive are well-known in the art. For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5): 1173-83 (2013)). In some embodiments, the nuclease inactive Cas9 domain is a dCas9 domain. In some embodiments, the nuclease inactive Cas9 domain is a Cas9n domain. In some embodiments, the nuclease inactive Cas9 domain of this disclosure comprises a D10A mutation of the amino acid sequence provided in SEQ ID NO: 10, or a corresponding mutation in any of the amino acid sequences provided in SEQ ID NOs: 11-260. In some embodiments, the nuclease inactive Cas9 domain of this disclosure comprises a H840A mutation of the amino acid sequence provided in SEQ ID NO: 10, or a corresponding mutation in any of the amino acid sequences provided in SEQ ID NOs: 11-260. In some embodiments, the nuclease inactive Cas9 domain of this disclosure comprises both D10A and H840A mutations of the amino acid sequence provided in SEQ ID NO: 10, or a corresponding mutation in any of the amino acid sequences provided in SEQ ID NOs: 11-260. In some embodiments, the nuclease inactive Cas9 domain comprises an amino acid sequence of SEQ ID NO: 6. In some embodiments, the nuclease inactive Cas9 domain further comprises a histidine residue at position 840 of the amino acid sequence provided in SEQ ID NO: 10, or a corresponding mutation in any of the amino acid sequences provided in SEQ ID NOs: 11-260. For example, the presence of the catalytic residue H840 restores the activity of the dCas9 domain to cleave the non-edited strand (i.e., the Cas9 domain is a Cas9 nickase domain) containing, for example, a G opposite the targeted C. Restoration of H840 does not result in the cleavage of the target strand containing the C. In some embodiments, the nuclease inactive Cas9 comprises an amino acid sequence of SEQ ID NO: 7. It is to be understood that other mutations that inactivate the nuclease domains of Cas9 may also be included in the nuclease inactive Cas9 domain (e.g., dCas9 domain, Cas9n domain) of this disclosure.

In some embodiments, the fusion protein comprises a nuclease-inactive Cas9 domain fused to one or more adenosine deaminase domains (e.g., a first adenosine deaminase and a second adenosine deaminase), wherein the fusion protein comprises or consists of the amino acid sequence of any one of SEQ ID NOs: 560-586. In some embodiments, the fusion protein comprises or consists of the amino acid sequence of SEQ ID NO: 586.

ecTadA(wt)-XTEN-nCas9-NLS:

(SEQ ID NO: 560)

MSEVEFSHEYWMRHALTLAKRAWDEREVPVGAVLVHNNRVIGEGWNRPIGRHDPTAHAEIMALRQGGLVMQNYR
LIDATLYVTLEPCVMCAGAMIHSRIGRVVFGARDAKTGAAGSLMDVLHHPGMNHRVEITEGILADECAALLSDF
FRMRRQEIKAQKKAQSSTD<i>SGSETPGTSESATPES</i>DKKYSIGLAIGTNSVGWAVITDEYKVPSKKEKVLGNTDR
HSIKKNLIGALLFDSGETAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEGDLNPDNSDVDKLFIQL
VQTYNQLFEENPINASGVDAKAILSARLSKSRRLENLIAQLPGEKKNGLFGNLIALSLGLTPNEKSNEDLAEDA
KLQLSKDTYDDDLDNLLAQIGDQYADLFLAAKNLSDAILLSDILRVNTEITKAPLSASMIKRYDEHHQDLTLLK
ALVRQQLPEKYKEIFFDQSKNGYAGYIDGGASQEEFYKFIKPILEKMDGTEELLVKLNREDLLRKQRTFDNGSI
PHQIHLGELHAILRRQEDFYPFLKDNREKIEKILTFRIPYYVGPLARGNSRFAWMTRKSEETITPWNFEEVVDK
GASAQSFIERMTNFDKNLPNEKVLPKHSLLYEYFTVYNELTKVKYVTEGMRKPAELSGEQKKAIVDLLFKTNRK
VTVKQLKEDYFKKIECFDSVEISGVEDRFNASLGTYHDLLKIIKDKDFLDNEENEDILEDIVLTLTLFEDREMI
EERLKTYAHLFDDKVMKQLKRRRYTGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKPENIVIEMARENQTTQKGQKNSRER
MKRIEEGIKELGSQILKEHPVENTQLQNEKLYLYYLQNGRDMYVDQELDINRLSDYDVDHIVPQSFLKDDSIDN
KVLTRSDKNRGKSDNVPSEEVVKKMKNYWRQLLNAKLITQRKEDNLTKAERGGLSELDKAGFIKRQLVETRQIT
KHVAQILDSRMNTKYDENDKLIREVKVITLKSKLVSDERKDFQFYKVREINNYHHAHDAYLNAVVGTALIKKYP
KLESEFVYGDYKVYDVRKMIAKSEQEIGKATAKYFFYSNIMNFFKTEITLANGEIRKRPLIETNGETGEIVWDK
GRDFATVRKVLSMPQVNIVKKTEVQTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPKYSLFELENGRKRMLASAGELQKGN
ELALPSKYVNFLYLASHYEKLKGSPEDNEQKQLFVEQHKHYLDEIIEQISEFSKRVILADANLDKVLSAYNKHR
DKPIREQAENIIHLFTLTNLGAPAAFKYFDTTIDRKRYTSTKEVLDATLIHQSITGLYETRIDLSQLGGDSGGS
<i>PKKKRKV</i> ecTadA(D108N)-XTEN-nCas9-NLS: (mammalian construct, active on DNA, A to G editing):

(SEQ ID NO: 561)

MSEVEFSHEYWMRHALTLAKRAWDEREVPVGAVLVHNNRVIGEGWNRPIGRHDPTAHAEIMALRQGGLVMQNYR
LIDATLYVTLEPCVMCAGAMIHSRIGRVVFGARNAKTGAAGSLMDVLHHPGMNHRVEITEGILADECAALLSDF
FRMRRQEIKAQKKAQSSTD<i>SGSETPGTSESATPES</i>DKKYSIGLAIGTNSVGWAVITDEYKVPSKKEKVLGNTDR
HSIKKNLIGALLFDSGETAEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEGDLNPDNSDVDKLFIQL
VQTYNQLFEENPINASGVDAKAILSARLSKSRRLENLIAQLPGEKKNGLFGNLIALSLGLTPNEKSNEDLAEDA
KLQLSKDTYDDDLDNLLAQIGDQYADLFLAAKNLSDAILLSDILRVNTEITKAPLSASMIKRYDEHHQDLTLLK
ALVRQQLPEKYKEIFFDQSKNGYAGYIDGGASQEEFYKFIKPILEKMDGTEELLVKLNREDLLRKQRTFDNGSI
PHQIHLGELHAILRRQEDFYPFLKDNREKIEKILTFRIPYYVGPLARGNSRFAWMTRKSEETITPWNFEEVVDK
GASAQSFIERMTNEDKNLPNEKVLPKHSLLYEYFTVYNELTKVKYVTEGMRKPAELSGEQKKAIVDLLEKTNRK
VTVKQLKEDYFKKIECEDSVEISGVEDRFNASLGTYHDLLKIIKDKDFLDNEENEDILEDIVLTLTLFEDREMI
EERLKTYAHLFDDKVMKQLKRRRYTGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKPENIVIEMARENQTTQKGQKNSRER
MKRIEEGIKELGSQILKEHPVENTQLQNEKLYLYYLQNGRDMYVDQELDINRLSDYDVDHIVPQSFLKDDSIDN
KVLTRSDKNRGKSDNVPSEEVVKKMKNYWRQLLNAKLITQRKEDNLTKAERGGLSELDKAGFIKRQLVETRQIT
KHVAQILDSRMNTKYDENDKLIREVKVITLKSKLVSDERKDFQFYKVREINNYHHAHDAYLNAVVGTALIKKYP

KLESEFVYGDYKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISEFSKRVILADANLDKVLSAYNKHR

DKPIREQAENIIHLFTLTNLGAPAAFKYFDTTIDRKRYTSTKEVLDATLIHQSITGLYETRIDLSQLGGDSGGS

*PKKKRKV* ecTadA(D108G)-XTEN-nCas9-NLS: (mammalian construct, active on DNA, A to G editing):

(SEQ ID NO: 562)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARG̲AKTGAAGSLMDVLHHPGMNHRVEITEGILADECAALLSDF

FRMRRQEIKAQKKAQSSTD_SGSETPGTSESATPES_DKKYSIGLAIGTNSVGWAVITDEYKVPSKKEKVLGNTDR

HSIKKNLIGALLFDSGETAEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEGDLNPDNSDVDKLFIQL

VQTYNQLFEENPINASGVDAKAILSARLSKSRRLENLIAQLPGEKKNGLFGNLIALSLGLTPNEKSNEDLAEDA

KLQLSKDTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAELSGEQKKAIVDLLEKTNRK

VTVKQLKEDYFKKIECEDSVEISGVEDRFNASLGTYHDLLKIIKDKDFLDNEENEDILEDIVLTLTLFEDREMI

EERLKTYAHLFDDKVMKQLKRRRYTGWGRLSRKLINGIRDKQSGKTILDFLKSDGFANRNFMQLIHDDSLTFKE

DIQKAQVSGQGDSLHEHIANLAGSPAIKKGILQTVKVVDELVKVMGRHKPENIVIEMARENQTTQKGQKNSRER

MKRIEEGIKELGSQILKEHPVENTQLQNEKLYLYYLQNGRDMYVDQELDINRLSDYDVDHIVPQSFLKDDSIDN

KVLTRSDKNRGKSDNVPSEEVVKKMKNYWRQLLNAKLITQRKFDNLTKAERGGLSELDKAGFIKRQLVETRQIT

KHVAQILDSRMNTKYDENDKLIREVKVITLKSKLVSDERKDFQFYKVREINNYHHAHDAYLNAVVGTALIKKYP

KLESEFVYGDYKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISEFSKRVILADANLDKVLSAYNKHR

DKPIREQAENIIHLFTLTNLGAPAAFKYFDTTIDRKRYTSTKEVLDATLIHQSITGLYETRIDLSQLGGDSGGS

*PKKKRKV* ecTadA(D108V)-XTEN-nCas9-NLS: (mammalian construct, active on DNA, A to G editing):

(SEQ ID NO: 563)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARV̲AKTGAAGSLMDVLHHPGMNHRVEITEGILADECAALLSDF

FRMRRQEIKAQKKAQSSTD_SGSETPGTSESATPES_DKKYSIGLAIGTNSVGWAVITDEYKVPSKKEKVLGNTDR

HSIKKNLIGALLFDSGETAEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEGDLNPDNSDVDKLFIQL

VQTYNQLFEENPINASGVDAKAILSARLSKSRRLENLIAQLPGEKKNGLFGNLIALSLGLTPNEKSNEDLAEDA

KLQLSKDTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAELSGEQKKAIVDLLEKTNRK

VTVKQLKEDYFKKIECEDSVEISGVEDRFNASLGTYHDLLKIIKDKDFLDNEENEDILEDIVLTLTLFEDREMI

EERLKTYAHLFDDKVMKQLKRRRYTGWGRLSRKLINGIRDKQSGKTILDFLKSDGFANRNFMQLIHDDSLTFKE

DIQKAQVSGQGDSLHEHIANLAGSPAIKKGILQTVKVVDELVKVMGRHKPENIVIEMARENQTTQKGQKNSRER

MKRIEEGIKELGSQILKEHPVENTQLQNEKLYLYYLQNGRDMYVDQELDINRLSDYDVDHIVPQSFLKDDSIDN

KVLTRSDKNRGKSDNVPSEEVVKKMKNYWRQLLNAKLITQRKEDNLTKAERGGLSELDKAGFIKRQLVETRQIT

KHVAQILDSRMNTKYDENDKLIREVKVITLKSKLVSDERKDFQFYKVREINNYHHAHDAYLNAVVGTALIKKYP

KLESEFVYGDYKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISEFSKRVILADANLDKVLSAYNKHR

DKPIREQAENIIHLFTLTNLGAPAAFKYFDTTIDRKRYTSTKEVLDATLIHQSITGLYETRIDLSQLGGDSGGS

*PKKKRKV* ecTadA(H8Y_D108N_N127S)-XTEN-dCas9:

(SEQ ID NO: 564)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARNAKTGAAGSLMDVLHHPGMSHRVEITEGILADECAALLSDF

FRMRRQEIKAQKKAQSSTD*SGSETPGTSESATPES*DKKYSIGLAIGTNSVGWAVITDEYKVPSKKFKVLGNTDR

HSIKKNLIGALLFDSGETAEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEGDLNPDNSDVDKLFIQL

VQTYNQLFEENPINASGVDAKAILSARLSKSRRLENLIAQLPGEKKNGLFGNLIALSLGLTPNFKSNFDLAEDA

KLQLSKDTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIVLTLTLFEDREMI

EERLKTYAHLFDDKVMKQLKRRRYTGWGRLSRKLINGIRDKQSGKTILDFLKSDGFANRNFMQLIHDDSLTFKE

DIQKAQVSGQGDSLHEHIANLAGSPAIKKGILQTVKVVDELVKVMGRHKPENIVIEMARENQTTQKGQKNSRER

MKRIEEGIKELGSQILKEHPVENTQLQNEKLYLYYLQNGRDMYVDQELDINRLSDYDVDAIVPQSFLKDDSIDN

KVLTRSDKNRGKSDNVPSEEVVKKMKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISEFSKRVILADANLDKVLSAYNKHR

DKPIREQAENIIHLFTLTNLGAPAAFKYFDTTIDRKRYTSTKEVLDATLIHQSITGLYETRIDLSQLGGD ecTadA(H8Y_D108N_N127S_E155X)-XTEN-dCas9; X = D, G or V:

(SEQ ID NO: 565)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARNAKTGAAGSLMDVLHHPGMSHRVEITEGILADECAALLSDF

FRMRRQXIKAQKKAQSSTD*SGSETPGTSESATPES*DKKYSIGLAIGTNSVGWAVITDEYKVPSKKFKVLGNTDR

HSIKKNLIGALLFDSGETAEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEGDLNPDNSDVDKLFIQL

-continued

VQTYNQLFEENPINASGVDAKAILSARLSKSRRLENLIAQLPGEKKNGLFGNLIALSLGLTPNFKSNFDLAEDA

KLQLSKDTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRTFDNGSI

PHQIHLGELHAILRRQEDFYPFLKDNREKIEKILTFRIPYYVGPLARGNSRFAWMTRKSEETITPWNFEEVVDK

GASAQSFIERMTNFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIVLTLTLFEDREMI

EERLKTYAHLFDDKVMKQLKRRRYTGWGRLSRKLINGIRDKQSGKTILDFLKSDGFANRNFMQLIHDDSLTFKE

DIQKAQVSGQGDSLHEHIANLAGSPAIKKGILQTVKVVDELVKVMGRHKPENIVIEMARENQTTQKGQKNSRER

MKRIEEGIKELGSQILKEHPVENTQLQNEKLYLYYLQNGRDMYVDQELDINRLSDYDVDAIVPQSFLKDDSIDN

KVLTRSDKNRGKSDNVPSEEVVKKMKNYWRQLLNAKLITQRKFDNLTKAERGGLSELDKAGFIKRQLVETRQIT

KHVAQILDSRMNTKYDENDKLIREVKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISEFSKRVILADANLDKVLSAYNKHR

DKPIREQAENIIHLFTLTNLGAPAAFKYFDTTIDRKRYTSTKEVLDATLIHQSITGLYETRIDLSQLGGD

ABE7.7: ecTadA(wild type)-(SGGS)2-XTEN-(SGGS)2-
ecTadA(W23L_H36L_P48A_R51L_L84F_A106V_D108N_H123Y_S146C_D147Y_R152P_E155V_I156F_K157N)-
(SGGS)2-XTEN-(SGGS)2_nCas9_SGGS_NLS (SEQ ID NO: 566)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPESS*GGSSGGSSEVEFSHEYWMRHALTLAKRALD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMPRQVFNAQKKAQSSTDSGGSS

GGS*SGSETPGTSESATPESS*GGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

-continued

ENIIHLFTLTNLGAPAAFKYFDTTIDRKRYTSTKEVLDATLIHQSITGLYETRIDLSQLGGDSGGS*PKKKRKV* pNMG-624 amino acid sequence: ecTadA*(wild type)*-32 a.a. linker-
ecTadA*(W23R_H36L_P48A_R51L_L84F_A106V_D108N_H123Y_S146C_D147Y_R152P_E155V_I156F_K157N)*-24 a.a.
linker_nCas9_SGGS_NLS (SEQ ID NO: 567)

**MSEVEFSHEYWMRHALTLAKRAWDEREVPVGAVLVHNNRVIGEGWNRPIGRHDPTAHAEIMALRQGGLVMQNYR
LIDATLYVTLEPCVMCAGAMIHSRIGRVVFGARDAKTGAAGSLMDVLHHPGMNHRVEITEGILADECAALLSDF
FRMRRQEIKAQKKAQSSTDSGGSSGGSSGSETPGTSESATPESSGGSSGGSSEVEFSHEYWMRHALTLAKRARD
EREVPVGAVLVLNNRVIGEGWNRAIGLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCYFFRMPRQVFNAQKKAQSSTD**SGGSS
GGSSGSETPGTSESATPES*DKKYSIGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFLVEEDKKHERHPIFGNIVDEVAYHE
KYPTIYHLRKKLVDSTDKADLRLIYLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKSNFDLAEDAKLQLSKDTYDDDLDNL
LAQIGDQYADLFLAAKNLSDAILLSDILRVNTEITKAPLSASMIKRYDEHHQDLTLLKALVRQQLPEKYKEIFF
DQSKNGYAGYIDGGASQEEFYKFIKPILEKMDGTEELLVKLNREDLLRKQRTFDNGSIPHQIHLGELHAILRRQ
EDFYPFLKDNREKIEKILTFRIPYYVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVDLLFKTNRKVTVKQLKEDYFKKIEC
FDSVEISGVEDRFNASLGTYHDLLKIIKDKDFLDNEENEDILEDIVLTLTLFEDREMIEERLKTYAHLFDDKVM
KQLKRRRYTGWGRLSRKLINGIRDKQSGKTILDFLKSDGFANRNFMQLIHDDSLTFKEDIQKAQVSGQGDSLHE
HIANLAGSPAIKKGILQTVKVVDELVKVMGRHKPENIVIEMARENQTTQKGQKNSRERMKRIEEGIKELGSQIL
KEHPVENTQLQNEKLYLYYLQNGRDMYVDQELDINRLSDYDVDHIVPQSFLKDDSIDNKVLTRSDKNRGKSDNV
PSEEVVKKMKNYWRQLLNAKLITQRKFDNLTKAERGGLSELDKAGFIKRQLVETRQITKHVAQILDSRMNTKYD
ENDKLIREVKVITLKSKLVSDFRKDFQFYKVREINNYHHAHDAYLNAVVGTALIKKYPKLESEFVYGDYKVYDV
RKMIAKSEQEIGKATAKYFFYSNIMNFFKTEITLANGEIRKRPLIETNGETGEIVWDKGRDFATVRKVLSMPQV
NIVKKTEVQTGGFSKESILPKRNSDKLIARKKDWDPKKYGGFDSPTVAYSVLVVAKVEKGKSKKLKSVKELLGI
TIMERSSFEKNPIDFLEAKGYKEVKKDLIIKLPKYSLFELENGRKRMLASAGELQKGNELALPSKYVNFLYLAS
HYEKLKGSPEDNEQKQLFVEQHKHYLDEIIEQISEFSKRVILADANLDKVLSAYNKHRDKPIREQAENIIHLFT
LTNLGAPAAFKYFDTTIDRKRYTSTKEVLDATLIHQSITGLYETRIDLSQLGGDSGGS*PKKKRKV***

ABE3.2: ecTadA*(wild-type)*-(SGGS)*₂*-XTEN-(SGGS)*₂*-
ecTadA*(L84F_A106v_D108N_H123Y_D147Y_E155V_I156F)*-(SGGS)*₂*-XTEN-
(SGGS)*₂*_nCas9_SGGS_NLS (SEQ ID NO: 568)

**MSEVEFSHEYWMRHALTLAKRAWDEREVPVGAVLVHNNRVIGEGWNRPIGRHDPTAHAEIMALRQGGLVMQNYR
LIDATLYVTLEPCVMCAGAMIHSRIGRVVFGARDAKTGAAGSLMDVLHHPGMNHRVEITEGILADECAALLSDF
FRMRRQEIKAQKKAQSSTD**SGGSSGGS*SGSETPGTSESATPES*SGGSSGGS**SEVEFSHEYWMRHALTLAKRAWD
EREVPVGAVLVHNNRVIGEGWNRPIGRHDPTAHAEIMALRQGGLVMQNYRLIDATLYVTFEPCVMCAGAMIHSR
IGRVVFGVRNAKTGAAGSLMDVLHYPGMNHRVEITEGILADECAALLSYFFRMRRQVFKAQKKAQSSTD**SGGSS
GGS*SGSETPGTSESATPES*SGGSSGGSDKKYSIGLAIGTNSVGWAVITDEYKVPSKKFKVLGNTDRHSIKKNLI
GALLFDSGETAEATRLKRTARRRYTRRKNRICYLQEIFSNEMAKVDDSFFHRLEESFLVEEDKKHERHPIFGNI
VDEVAYHEKYPTIYHLRKKLVDSTDKADLRLIYLALAHMIKFRGHFLIEGDLNPDNSDVDKLFIQLVQTYNQLF
EENPINASGVDAKAILSARLSKSRRLENLIAQLPGEKKNGLFGNLIALSLGLTPNFKSNFDLAEDAKLQLSKDT
YDDDLDNLLAQIGDQYADLFLAAKNLSDAILLSDILRVNTEITKAPLSASMIKRYDEHHQDLTLLKALVRQQLP
EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGD SGGS *PKKKRKV*

ABE5.3: ecTadA$_{(wild-type)}$-(SGGS)$_2$-XTEN-(SGGS)$_2$-
ecTadA$_{(H36L\_R51L\_L84F\_A106V\_D108N\_H123Y\_S146C\_D147Y\_E155V\_I156F\_K157N)}$-(SGGS)$_2$-XTEN-
(SGGS)$_2$_nCas9_SGGS_NLS (SEQ ID NO: 569)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPES*SGGSSGGSSEVEFSHEYWMRHALTLAKRAWD

EREVPVGAVLVLNNRVIGEGWNRPIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMRRQVFNAQKKAQSSTDSGGSS

GGS*SGSETPGTSESATPES*SGGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV* pNMG-558 amino acid sequence: ecTadA$_{(wild\text{-}type)}$ - 32 a.a. linker-
ecTadA$_{(H36L\_R51L\_L84F\_A106V\_D108N\_H123Y\_S146C\_D147Y\_E155V\_I156F\_K157N)}$ -24 a.a.
linker_nCas9_SGGS_NLS (SEQ ID NO: 570)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTD*SGGSSGGSSGSETPGTSESATPESSGGSSGGS*SEVEFSHEYWMRHALTLAKRAWD

EREVPVGAVLVLNNRVIGEGWNRPIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMRRQVFNAQKKAQSSTD*SGGS*

*GGSSGSETPGTSESATPES*DKKYSIGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFLVEEDKKHERHPIFGNIVDEVAYHE

KYPTIYHLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQRTFDNGSIPHQIHLGELHAILRRQ

EDFYPFLKDNREKIEKILTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNRKVTVKQLKEDYFKKIEC

FDSVEISGVEDRFNASLGTYHDLLKIIKDKDFLDNEENEDILEDIVLTLTLFEDREMIEERLKTYAHLFDDKVM

KQLKRRRYTGWGRLSRKLINGIRDKQSGKTILDFLKSDGFANRNFMQLIHDDSLTFKEDIQKAQVSGQGDSLHE

HIANLAGSPAIKKGILQTVKVVDELVKVMGRHKPENIVIEMARENQTTQKGQKNSRERMKRIEEGIKELGSQIL

KEHPVENTQLQNEKLYLYYLQNGRDMYVDQELDINRLSDYDVDHIVPQSFLKDDSIDNKVLTRSDKNRGKSDNV

PSEEVVKKMKNYWRQLLNAKLITQRKFDNLTKAERGGLSELDKAGFIKRQLVETRQITKHVAQILDSRMNTKYD

ENDKLIREVKVITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQLGGDSGGS*PKKKRKV* pNMG-576 amino acid sequence: ecTadA$_{(wild\text{-}type)}$ - (SGGS)$_2$-XTEN- (SGGS)$_2$-
ecTadA$_{(H36L\_P48S\_R51L\_L84F\_A106V\_D108N\_H123Y\_S146C\_D147Y\_E155V\_I156F\_K157N)}$ - (SGGS)$_2$-XTEN-
(SGGS)$_2$_nCas9_GGS_NLS (SEQ ID NO: 571)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTD*SGGSSGGSSGSETPGTSESATPESSGGSSGGS*SEVEFSHEYWMRHALTLAKRAWD

EREVPVGAVLVLNNRVIGEGWNRSIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMRRQVFNAQKKAQSSTDSGGS

GGS*SGSETPGTSESATPES*SGGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI
ERMTNFDKNLPNEKVLPKHSLLYEYFTVYNELTKVKYVTEGMRKPAFLSGEQKKAIVDLLFKTNRKVTVKQLKE
DYFKKIECFDSVEISGVEDRFNASLGTYHDLLKIIKDKDFLDNEENEDILEDIVLTLTLFEDREMIEERLKTYA
HLFDDKVMKQLKRRRYTGWGRLSRKLINGIRDKQSGKTILDFLKSDGFANRNFMQLIHDDSLTFKEDIQKAQVS
GQGDSLHEHIANLAGSPAIKKGILQTVKVVDELVKVMGRHKPENIVIEMARENQTTQKGQKNSRERMKRIEEGI
KELGSQILKEHPVENTQLQNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIKRQLVETRQITKHVAQILD
SRMNTKYDENDKLIREVKVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGETGEIVWDKGRDFATVR
KVLSMPQVNIVKKTEVQTGGFSKESILPKRNSDKLIARKKDWDPKKYGGFDSPTVAYSVLVVAKVEKGKSKKLK
SVKELLGITIMERSSFEKNPIDFLEAKGYKEVKKDLIIKLPKYSLFELENGRKRMLASAGELQKGNELALPSKY
VNFLYLASHYEKLKGSPEDNEQKQLFVEQHKHYLDEIIEQISEFSKRVILADANLDKVLSAYNKHRDKPIREQA
ENIIHLFTLTNLGAPAAFKYFDTTIDRKRYTSTKEVLDATLIHQSITGLYETRIDLSQLGGDSGGS*PKKKRKV* pNMG-577 amino acid sequence: ecTadA*(wild-type)*-(SGGS)₂-XTEN-(SGGS)₂-
ecTadA*(H36L_P48S_R51L_L84F_A106V_D108N_H123Y_A142N_S146C_D147Y_E155V_I156F_K157N)*-(SGGS)₂-
XTEN-(SGGS)₂_nCas9_GGS_NLS (SEQ ID NO: 572)

MSEVEFSHEYWMRHALTLAKRAWDEREVPVGAVLVHNNRVIGEGWNRPIGRHDPTAHAEIMALRQGGLVMQNYR
LIDATLYVTLEPCVMCAGAMIHSRIGRVVFGARDAKTGAAGSLMDVLHHPGMNHRVEITEGILADECAALLSDF
FRMRRQEIKAQKKAQSSTDSGGSSGGS*SGSETPGTSESATPESS*SGGSSGGSSEVEFSHEYWMRHALTLAKRAWD
EREVPVGAVLVLNNRVIGEGWNRSIGLHDPTAHAEIMALRQGGLVMQNYRLIDATLYVTFEPCVMCAGAMIHSR
IGRVVFGVRNAKTGAAGSLMDVLHYPGMNHRVEITEGILADECNALLCYFFRMRRQVFNAQKKAQSSTDSGGSS
GGS*SGSETPGTSESATPESS*SGGSSGGSDKKYSIGLAIGTNSVGWAVITDEYKVPSKKFKVLGNTDRHSIKKNLI
GALLFDSGETAEATRLKRTARRRYTRRKNRICYLQEIFSNEMAKVDDSFFHRLEESFLVEEDKKHERHPIFGNI
VDEVAYHEKYPTIYHLRKKLVDSTDKADLRLIYLALAHMIKFRGHFLIEGDLNPDNSDVDKLFIQLVQTYNQLF
EENPINASGVDAKAILSARLSKSRRLENLIAQLPGEKKNGLFGNLIALSLGLTPNFKSNFDLAEDAKLQLSKDT
YDDDLDNLLAQIGDQYADLFLAAKNLSDAILLSDILRVNTEITKAPLSASMIKRYDEHHQDLTLLKALVRQQLP
EKYKEIFFDQSKNGYAGYIDGGASQEEFYKFIKPILEKMDGTEELLVKLNREDLLRKQRTFDNGSIPHQIHLGE
LHAILRRQEDFYPFLKDNREKIEKILTFRIPYYVGPLARGNSRFAWMTRKSEETITPWNFEEVVDKGASAQSFI
ERMTNFDKNLPNEKVLPKHSLLYEYFTVYNELTKVKYVTEGMRKPAFLSGEQKKAIVDLLFKTNRKVTVKQLKE
DYFKKIECFDSVEISGVEDRFNASLGTYHDLLKIIKDKDFLDNEENEDILEDIVLTLTLFEDREMIEERLKTYA
HLFDDKVMKQLKRRRYTGWGRLSRKLINGIRDKQSGKTILDFLKSDGFANRNFMQLIHDDSLTFKEDIQKAQVS
GQGDSLHEHIANLAGSPAIKKGILQTVKVVDELVKVMGRHKPENIVIEMARENQTTQKGQKNSRERMKRIEEGI
KELGSQILKEHPVENTQLQNEKLYLYYLQNGRDMYVDQELDINRLSDYDVDHIVPQSFLKDDSIDNKVLTRSDK
NRGKSDNVPSEEVVKKMKNYWRQLLNAKLITQRKFDNLTKAERGGLSELDKAGFIKRQLVETRQITKHVAQILD
SRMNTKYDENDKLIREVKVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGETGEIVWDKGRDFATVR
KVLSMPQVNIVKKTEVQTGGFSKESILPKRNSDKLIARKKDWDPKKYGGFDSPTVAYSVLVVAKVEKGKSKKLK
SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV* pNMG-586 amino acid sequence: ecTadA<sub>(wild-type)</sub>-(SGGS)<sub>2</sub>-XTEN-(SGGS)<sub>2</sub>-
eCTadA<sub>(H36L_P48A_R51L_L84F_A106V_D108N_H123Y_S146C_D147Y_E155V_I156F_K157N)</sub>-(SGGS)<sub>2</sub>-XTEN-
(SGGS)<sub>2</sub>_nCas9_GGS_NLS (SEQ ID NO: 573)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPESS*GGSSGGSSEVEFSHEYWMRHALTLAKRAWD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMRRQVFNAQKKAQSSTDSGGSS

GGS*SGSETPGTSESATPESS*GGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV*

ABE7.2: ecTadA<sub>(wild-type)</sub>-(SGGS)<sub>2</sub>-XTEN-(SGGS)<sub>2</sub>-
eCTadA<sub>(H36L_P48A_R51L_L84F_A106V_D108N_H123Y_A142N_S146C_D147Y_E155V_I156F_K157N)</sub>-(SGGS)<sub>2</sub>-
XTEN-(SGGS)<sub>2</sub>_nCas9_GGS_NLS (SEQ ID NO: 574)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPESS*GGSSGGSSEVEFSHEYWMRHALTLAKRAWD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECNALLCYFFRMRRQVFNAQKKAQSSTDSGGSS

GGS*SGSETPGTSESATPESS*GGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

-continued

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV* pNMG-620 amino acid sequence: ecTadA<sub>(wild-type)</sub>-(SGGS)<sub>2</sub>-XTEN-(SGGS)<sub>2</sub>-
ecTadA<sub>(W23R_H36L_P48A_R51L_L84F_A106V_D108N_H123Y_S146C_D147Y_R152P_E155V_I156F_K157N)</sub>-
(SGGS)<sub>2</sub>-XTEN-(SGGS)<sub>2</sub>_nCas9_GGS_NLS (SEQ ID NO: 575)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPESS*GGSSGGSSEVEFSHEYWMRHALTLAKRARD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMPRQVFNAQKKAQSSTDSGGSS

GGS*SGSETPGTSESATPESS*GGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

-continued

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV* pNMG-617 amino acid sequence: ecTadA$_{(wild-type)}$-(SGGS)$_2$-XTEN-(SGGS)$_2$-
eCTadA$_{(W23L\_H36L\_P48A\_R51L\_L84F\_A106V\_D108N\_H123Y\_A142A\_S146C\_D147Y\_E155V\_I156F\_K157N)}$-
(SGGS)$_2$-XTEN-(SGGS)$_2$_nCas9_GGS_NLS (SEQ ID NO: 576)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPESS*GGSSGGSSEVEFSHEYWMRHALTLAKRALD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECNALLCYFFRMRRQVFNAQKKAQSSTDSGGSS

GGS*SGSETPGTSESATPESS*GGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV* pNMG-618 amino acid sequence: ecTadA$_{(wild-type)}$-(SGGS)$_2$-XTEN-(SGGS)$_2$-
eCTadA$_{(W23L\_H36L\_P48A\_R51L\_L84F\_A106V\_D108N\_H123Y\_A142A\_S146C\_D147Y\_R152P\_E155V\_I156F\_K157N)}$-
(SGGS)$_2$-XTEN-(SGGS)$_2$_nCas9_GGS_NLS (SEQ ID NO: 577)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPESS*GGSSGGSSEVEFSHEYWMRHALTLAKRALD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECNALLCYFFRMPRQVFNAQKKAQSSTDSGGSS

GGS*SGSETPGTSESATPESS*GGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV* pNMG-620 amino acid sequence: ecTadA$_{(wild-type)}$-(SGGS)$_2$-XTEN-(SGGS)$_2$-
ecTadA$_{(W23R\_H36L\_P48A\_R51L\_L84F\_A106V\_D108N\_H123Y\_S146C\_D147Y\_R152P\_E155V\_I156F\_K157N)}$-
(SGGS)$_2$-XTEN-(SGGS)$_2$_nCas9_GGS_NLS (SEQ ID NO: 578)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTDSGGSSGGS*SGSETPGTSESATPESS*GGSSGGSSEVEFSHEYWMRHALTLAKRARD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMPRQVFNAQKKAQSSTDSGGSS

GGS*SGSETPGTSESATPESS*GGSSGGSDKKYSIGLAIGTNSVGWAVITDEYKVPSKKFKVLGNTDRHSIKKNLI

GALLFDSGETAEATRLKRTARRRYTRRKNRICYLQEIFSNEMAKVDDSFFHRLEESFLVEEDKKHERHPIFGNI

VDEVAYHEKYPTIYHLRKKLVDSTDKADLRLIYLALAHMIKFRGHFLIEGDLNPDNSDVDKLFIQLVQTYNQLF

EENPINASGVDAKAILSARLSKSRRLENLIAQLPGEKKNGLFGNLIALSLGLTPNFKSNFDLAEDAKLQLSKDT

YDDDLDNLLAQIGDQYADLFLAAKNLSDAILLSDILRVNTEITKAPLSASMIKRYDEHHQDLTLLKALVRQQLP

EKYKEIFFDQSKNGYAGYIDGGASQEEFYKFIKPILEKMDGTEELLVKLNREDLLRKQRTFDNGSIPHQIHLGE

LHAILRRQEDFYPFLKDNREKIEKILTFRIPYYVGPLARGNSRFAWMTRKSEETITPWNFEEVVDKGASAQSFI

ERMTNFDKNLPNEKVLPKHSLLYEYFTVYNELTKVKYVTEGMRKPAFLSGEQKKAIVDLLFKTNRKVTVKQLKE

DYFKKIECFDSVEISGVEDRFNASLGTYHDLLKIIKDKDFLDNEENEDILEDIVLTLTFEDREMIEERLKTYA

HLFDDKVMKQLKRRRYTGWGRLSRKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMARENQTTQKGQKNSRERMKRIEEGI

KELGSQILKEHPVENTQLQNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIKRQLVETRQITKHVAQILD

SRMNTKYDENDKLIREVKVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGETGEIVWDKGRDFATVR

KVLSMPQVNIVKKTEVQTGGFSKESILPKRNSDKLIARKKDWDPKKYGGFDSPTVAYSVLVVAKVEKGKSKKLK

SVKELLGITIMERSSFEKNPIDFLEAKGYKEVKKDLIIKLPKYSLFELENGRKRMLASAGELQKGNELALPSKY

VNFLYLASHYEKLKGSPEDNEQKQLFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLYETRIDLSQLGGDSGGS*PKKKRKV* pNMG-621 amino acid sequence: ecTadA$_{(wild-type)}$-32 a.a. linker-eCTadA$_{(H36L\_P48A\_R51L\_L84F\_A106V\_D108N\_H123Y\_S146C\_D147Y\_R152P\_E155V\_I156F\_K157N)}$-24 a.a. linker_nCas9_GGS_NLS (SEQ ID NO: 579)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTD*SGGSSGGSSGSETPGTSESATPESSGGSSGGS*SEVEFSHEYWMRHALTLAKRAWD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMPRQVFNAQKKAQSSTD*SGGSS

GGSSGSETPGTSESATPES*DKKYSIGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFLVEEDKKHERHPIFGNIVDEVAYHE

KYPTIYHLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQRTFDNGSIPHQIHLGELHAILRRQ

EDFYPFLKDNREKIEKILTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNRKVTVKQLKEDYFKKIEC

FDSVEISGVEDRFNASLGTYHDLLKIIKDKDFLDNEENEDILEDIVLTLTLFEDREMIEERLKTYAHLFDDKVM

KQLKRRRYTGWGRLSRKLINGIRDKQSGKTILDFLKSDGFANRNFMQLIHDDSLTFKEDIQKAQVSGQGDSLHE

HIANLAGSPAIKKGILQTVKVVDELVKVMGRHKPENIVIEMARENQTTQKGQKNSRERMKRIEEGIKELGSQIL

KEHPVENTQLQNEKLYLYYLQNGRDMYVDQELDINRLSDYDVDHIVPQSFLKDDSIDNKVLTRSDKNRGKSDNV

PSEEVVKKMKNYWRQLLNAKLITQRKFDNLTKAERGGLSELDKAGFIKRQLVETRQITKHVAQILDSRMNTKYD

ENDKLIREVKVITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQLGGDSGGS*PKKKRKV* pNMG-622 amino acid sequence: ecTadA$_{(wild-type)}$-32 a.a. linker-eCTadA$_{(H36L\_P48A\_R51L\_L84F\_A106V\_D108N\_H123Y\_A142N\_S146C\_D147Y\_R152P\_E155V\_I156F\_K157N)}$-24 a.a. linker_nCas9_GGS_NLS (SEQ ID NO: 580)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTD*SGGSSGGSSGSETPGTSESATPESSGGSSGGS*SEVEFSHEYWMRHALTLAKRAWD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECNALLCYFFRMPRQVFNAQKKAQSSTD*SGGSS

GGSSGSETPGTSESATPES*DKKYSIGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFLVEEDKKHERHPIFGNIVDEVAYHE

KYPTIYHLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQRTFDNGSIPHQIHLGELHAILRRQ

EDFYPFLKDNREKIEKILTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNRKVTVKQLKEDYFKKIEC

FDSVEISGVEDRFNASLGTYHDLLKIIKDKDFLDNEENEDILEDIVLTLTLFEDREMIEERLKTYAHLFDDKVM

KQLKRRRYTGWGRLSRKLINGIRDKQSGKTILDFLKSDGFANRNFMQLIHDDSLTFKEDIQKAQVSGQGDSLHE

HIANLAGSPAIKKGILQTVKVVDELVKVMGRHKPENIVIEMARENQTTQKGQKNSRERMKRIEEGIKELGSQIL

KEHPVENTQLQNEKLYLYYLQNGRDMYVDQELDINRLSDYDVDHIVPQSFLKDDSIDNKVLTRSDKNRGKSDNV

PSEEVVKKMKNYWRQLLNAKLITQRKFDNLTKAERGGLSELDKAGFIKRQLVETRQITKHVAQILDSRMNTKYD

ENDKLIREVKVITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQLGGDSGGS*PKKKRKV* pNMG-623 amino acid sequence: ecTadA$_{(wild\text{-}type)}$-32 a.a. linker-ecTadA$_{(W23L\_H36L\_P48A\_R51L\_L84F\_A106V\_D108N\_H123Y\_S146C\_D147Y\_R152P\_E155V\_I156F\_K157N)}$-24 a.a. linker_nCas9_GGS_NLS (SEQ ID NO: 581)

MSEVEFSHEYWMRHALTLAKRAWDEREVPVGAVLVHNNRVIGEGWNRPIGRHDPTAHAEIMALRQGGLVMQNYR

LIDATLYVTLEPCVMCAGAMIHSRIGRVVFGARDAKTGAAGSLMDVLHHPGMNHRVEITEGILADECAALLSDF

FRMRRQEIKAQKKAQSSTD_SGGSSGGSSGSETPGTSESATPESSGGSSGGS_SEVEFSHEYWMRHALTLAKRALD

EREVPVGAVLVLNNRVIGEGWNRAIGLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCYFFRMPRQVFNAQKKAQSSTD_SGGSS_

_GGSSGSETPGTSESATPES_DKKYSIGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFLVEEDKKHERHPIFGNIVDEVAYHE

KYPTIYHLRKKLVDSTDKADLRLIYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQRTFDNGSIPHQIHLGELHAILRRQ

EDFYPFLKDNREKIEKILTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNRKVTVKQLKEDYFKKIEC

FDSVEISGVEDRFNASLGTYHDLLKIIKDKDFLDNEENEDILEDIVLTLTLFEDREMIEERLKTYAHLFDDKVM

KQLKRRRYTGWGRLSRKLINGIRDKQSGKTILDFLKSDGFANRNFMQLIHDDSLTFKEDIQKAQVSGQGDSLHE

HIANLAGSPAIKKGILQTVKVVDELVKVMGRHKPENIVIEMARENQTTQKGQKNSRERMKRIEEGIKELGSQIL

KEHPVENTQLQNEKLYLYYLQNGRDMYVDQELDINRLSDYDVDHIVPQSFLKDDSIDNKVLTRSDKNRGKSDNV

PSEEVVKKMKNYWRQLLNAKLITQRKFDNLTKAERGGLSELDKAGFIKRQLVETRQITKHVAQILDSRMNTKYD

ENDKLIREVKVITLKSKLVSDFRKDFQFYKVREINNYHHAHDAYLNAVVGTALIKKYPKLESEFVYGDYKVYDV

RKMIAKSEQEIGKATAKYFFYSNIMNFFKTEITLANGEIRKRPLIETNGETGEIVWDKGRDFATVRKVLSMPQV

NIVKKTEVQTGGFSKESILPKRNSDKLIARKKDWDPKKYGGFDSPTVAYSVLVVAKVEKGKSKKLKSVKELLGI

TIMERSSFEKNPIDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPIREQAENIIHLFT

LTNLGAPAAFKYFDTTIDRKRYTSTKEVLDATLIHQSITGLYETRIDLSQLGGDSGGS*PKKKRKV*

ABE6.3: ecTadA$_{(wild-type)}$-(SGGS)$_2$-XTEN-(SGGS)$_2$-
ecTadA$_{(H36L\_P48S\_R51L\_L84F\_A106V\_D108N\_H123Y\_S146C\_D147Y\_E155V\_I156F\_K157N)}$-(SGGS)$_2$-XTEN-
(SGGS)$_2$_nCas9_SGGS_NLS
(SEQ ID NO: 582)

MSEVEFSHEYWMRHALTLAKRAWDEREVPVGAVLVHNNRVIGEGWNRPIGRHDPTAHAEIMALRQGGLVMQNY

RLIDATLYVTLEPCVMCAGAMIHSRIGRVVFGARDAKTGAAGSLMDVLHHPGMNHRVEITEGILADECAALLS

DFFRMRRQEIKAQKKAQSSTDSGGSSGGS*SGSETPGTSESATPESS*GGSSGGSSEVEFSHEYWMRHALTLAKR

AWDEREVPVGAVLVLNNRVIGEGWNRSIGLHDPTAHAEIMALRQGGLVMQNYRLIDATLYVTFEPCVMCAGAM

IHSRIGRVVFGVRNAKTGAAGSLMDVLHYPGMNHRVEITEGILADECAALLCYFFRMRRQVFNAQKKAQSSTD

SGGS*SGGSSGSETPGTSESATPESS*GGSSGGSDKKYSIGLAIGTNSVGWAVITDEYKVPSKKFKVLGNTDRHS

IKKNLIGALLFDSGETAEATRLKRTARRRYTRRKNRICYLQEIFSNEMAKVDDSFFHRLEESFLVEEDKKHER

HPIFGNIVDEVAYHEKYPTIYHLRKKLVDSTDKADLRLIYLALAHMIKFRGHFLIEGDLNPDNSDVDKLFIQL

VQTYNQLFEENPINASGVDAKAILSARLSKSRRLENLIAQLPGEKKNGLFGNLIALSLGLTPNFKSNFDLAED

AKLQLSKDTYDDDLDNLLAQIGDQYADLFLAAKNLSDAILLSDILRVNTEITKAPLSASMIKRYDEHHQDLTL

LKALVRQQLPEKYKEIFFDQSKNGYAGYIDGGASQEEFYKFIKPILEKMDGTEELLVKLNREDLLRKQRTFDN

GSIPHQIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKKAIVDLLF

KTNRKVTVKQLKEDYFKKIECFDSVEISGVEDRFNASLGTYHDLLKIIKDKDFLDNEENEDILEDIVLTLTLF

EDREMIEERLKTYAHLFDDKVMKQLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVKVMGRHKPENIVIEMARENQTTQK

GQKNSRERMKRIEEGIKELGSQILKEHPVENTQLQNEKLYLYYLQNGRDMYVDQELDINRLSDYDVDHIVPQS

FLKDDSIDNKVLTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINNYHHAHDAYLNA

VVGTALIKKYPKLESEFVYGDYKVYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEFSKRVILA

DANLDKVLSAYNKHRDKPIREQAENIIHLFTTNLGAPAAFKYFDTTIDRKRYTSTKEVLDATLIHQSITG

LYETRIDLSQLGGDSGGS*PKKKRKV*

ABE6.4: ecTadA$_{(wild-type)}$-(SGGS)$_2$-XTEN-(SGGS)$_2$-
ecTadA$_{(H36L\_P48S\_R51L\_L84F\_A106V\_D108N\_H123Y\_A142N\_S146C\_D147Y\_E155V\_I156F\_K157N)}$-(SGGS)$_2$-
XTEN-(SGGS)$_2$_nCas9_SGGS_NLS
(SEQ ID NO: 583)

MSEVEFSHEYWMRHALTLAKRAWDEREVPVGAVLVHNNRVIGEGWNRPIGRHDPTAHAEIMALRQGGLVMQNY

RLIDATLYVTLEPCVMCAGAMIHSRIGRVVFGARDAKTGAAGSLMDVLHHPGMNHRVEITEGILADECAALLS

DFFRMRRQEIKAQKKAQSSTDSGGSSGGS*SGSETPGTSESATPESS*GGSSGGSSEVEFSHEYWMRHALTLAKR

AWDEREVPVGAVLVLNNRVIGEGWNRSIGLHDPTAHAEIMALRQGGLVMQNYRLIDATLYVTFEPCVMCAGAM

IHSRIGRVVFGVRNAKTGAAGSLMDVLHYPGMNHRVEITEGILADECNALLCYFFRMRRQVFNAQKKAQSSTD

SGGS*SGGSSGSETPGTSESATPESS*GGSSGGSDKKYSIGLAIGTNSVGWAVITDEYKVPSKKFKVLGNTDRHS

IKKNLIGALLFDSGETAEATRLKRTARRRYTRRKNRICYLQEIFSNEMAKVDDSFFHRLEESFLVEEDKKHER

HPIFGNIVDEVAYHEKYPTIYHLRKKLVDSTDKADLRLIYLALAHMIKFRGHFLIEGDLNPDNSDVDKLFIQL

VQTYNQLFEENPINASGVDAKAILSARLSKSRRLENLIAQLPGEKKNGLFGNLIALSLGLTPNFKSNFDLAED

-continued

AKLQLSKDTYDDDLDNLLAQIGDQYADLFLAAKNLSDAILLSDILRVNTEITKAPLSASMIKRYDEHHQDLTL
LKALVRQQLPEKYKEIFFDQSKNGYAGYIDGGASQEEFYKFIKPILEKMDGTEELLVKLNREDLLRKQRTFDN
GSIPHQIHLGELHAILRRQEDFYPFLKDNREKIEKILTFRIPYYVGPLARGNSRFAWMTRKSEETITPWNFEE
VVDKGASAQSFIERMTNFDKNLPNEKVLPKHSLLYEYFTVYNELTKVKYVTEGMRKPAFLSGEQKKAIVDLLF
KTNRKVTVKQLKEDYFKKIECFDSVEISGVEDRFNASLGTYHDLLKIIKDKDFLDNEENEDILEDIVLTLTLF
EDREMIEERLKTYAHLFDDKVMKQLKRRRYTGWGRLSRKLINGIRDKQSGKTILDFLKSDGFANRNFMQLIHD
DSLTFKEDIQKAQVSGQGDSLHEHIANLAGSPAIKKGILQTVKVVDELVKVMGRHKPENIVIEMARENQTTQK
GQKNSRERMKRIEEGIKELGSQILKEHPVENTQLQNEKLYLYYLQNGRDMYVDQELDINRLSDYDVDHIVPQS
FLKDDSIDNKVLTRSDKNRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKVREINNYHHAHDAYLNA
VVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSP
TVAYSVLVVAKVEKGKSKKLKSVKELLGITIMERSSFEKNPIDFLEAKGYKEVKKDLIIKLPKYSLFELENGR
KRMLASAGELQKGNELALPSKYVNFLYLASHYEKLKGSPEDNEQKQLFVEQHKHYLDEIIEQISEFSKRVILA
DANLDKVLSAYNKHRDKPIREQAENIIHLFTLTNLGAPAAFKYFDTTIDRKRYTSTKEVLDATLIHQSITG
LYETRIDLSQLGGD*SGGS*PKKKRKV

ABE7.8: ecTadA(wild-type)-(SGGS)₂-XTEN-(SGGS)₂-
ecTadA(W23L_H36L_P48A_R51L_L84F_A106V_D108N_H123Y_A142N_S146C_D147Y_E155V_I156F_K157N)-
(SGGS)₂-XTEN-(SGGS)₂_nCas9_SGGS_NLS (SEQ ID NO: 584)

MSEVEFSHEYWMRHALTLAKRAWDEREVPVGAVLVHNNRVIGEGWNRPIGRHDPTAHAEIMALRQGGLVMQNY
RLIDATLYVTLEPCVMCAGAMIHSRIGRVVFGARDAKTGAAGSLMDVLHHPGMNHRVEITEGILADECAALLS
DFFRMRRQEIKAQKKAQSSTDSGGSSGGS*SGSETPGTSESATPESS*GGSSGGSSEVEFSHEYWMRHALTLAKR
ALDEREVPVGAVLVLNNRVIGEGWNRAIGLHDPTAHAEIMALRQGGLVMQNYRLIDATLYVTFEPCVMCAGAM
IHSRIGRVVFGVRNAKTGAAGSLMDVLHYPGMNHRVEITEGILADECNALLCYFFRMRRQVFNAQKKAQSSTD
SGGS*SGGSSGSETPGTSESATPESS*GGSSGGSDKKYSIGLAIGTNSVGWAVITDEYKVPSKKFKVLGNTDRHS
IKKNLIGALLFDSGETAEATRLKRTARRRYTRRKNRICYLQEIFSNEMAKVDDSFFHRLEESFLVEEDKKHER
HPIFGNIVDEVAYHEKYPTIYHLRKKLVDSTDKADLRLIYLALAHMIKFRGHFLIEGDLNPDNSDVDKLFIQL
VQTYNQLFEENPINASGVDAKAILSARLSKSRRLENLIAQLPGEKKNGLFGNLIALSLGLTPNFKSNFDLAED
AKLQLSKDTYDDDLDNLLAQIGDQYADLFLAAKNLSDAILLSDILRVNTEITKAPLSASMIKRYDEHHQDLTL
LKALVRQQLPEKYKEIFFDQSKNGYAGYIDGGASQEEFYKFIKPILEKMDGTEELLVKLNREDLLRKQRTFDN
GSIPHQIHLGELHAILRRQEDFYPFLKDNREKIEKILTFRIPYYVGPLARGNSRFAWMTRKSEETITPWNFEE
VVDKGASAQSFIERMTNFDKNLPNEKVLPKHSLLYEYFTVYNELTKVKYVTEGMRKPAFLSGEQKKAIVDLLF
KTNRKVTVKQLKEDYFKKIECFDSVEISGVEDRFNASLGTYHDLLKIIKDKDFLDNEENEDILEDIVLTLTLF
EDREMIEERLKTYAHLFDDKVMKQLKRRRYTGWGRLSRKLINGIRDKQSGKTILDFLKSDGFANRNFMQLIHD
DSLTFKEDIQKAQVSGQGDSLHEHIANLAGSPAIKKGILQTVKVVDELVKVMGRHKPENIVIEMARENQTTQK
GQKNSRERMKRIEEGIKELGSQILKEHPVENTQLQNEKLYLYYLQNGRDMYVDQELDINRLSDYDVDHIVPQS
FLKDDSIDNKVLTRSDKNRGKSDNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKDFQFYKVREINNYHHAHDAYLNA
VVGTALIKKYPKLESEFVYGDYKVYDVRKMIAKSEQEIGKATAKYFFYSNIMNFFKTEITLANGEIRKRPLIE
TNGETGEIVWDKGRDFATVRKVLSMPQVNIVKKTEVQTGGFSKESILPKRNSDKLIARKKDWDPKKYGGFDSP
TVAYSVLVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEFSKRVILA

DANLDKVLSAYNKHRDKPIREQAENIIHLFTLTNLGAPAAFKYFDTTIDRKRYTSTKEVLDATLIHQSITGL

YETRIDLSQLGGD*SGGS*PKKKRKV

ABE7.9: ecTadA$_{(wild-type)}$-(SGGS)$_2$-XTEN-(SGGS)$_2$-
ecTadA$_{(W23L\_H36L\_P48A\_R51L\_L84F\_A106V\_D108N\_H123Y\_A142N\_S146C\_D147Y\_R152P\_E155V\_I156F\_K157N)}$-
(SGGS)$_2$-XTEN-(SGGS)$_2$_nCas9_SGGS_NLS (SEQ ID NO: 585)

MSEVEFSHEYWMRHALTLAKRAWDEREVPVGAVLVHNNRVIGEGWNRPIGRHDPTAHAEIMALRQGGLVMQNY

RLIDATLYVTLEPCVMCAGAMIHSRIGRVVFGARDAKTGAAGSLMDVLHHPGMNHRVEITEGILADECAALLS

DFFRMRRQEIKAQKKAQSSTDSGGSSGGS*SGSETPGTSESATPESS*GGSSGGSSEVEFSHEYWMRHALTLAKR

ALDEREVPVGAVLVLNNRGEGWNRAIGLHDPTAHAEIMALRQGGLVMQNYRLIDATLYVTFEPCVMCAGAMIH

SRIGRVVFGVRNAKTGAAGSLMDVLHYPGMNHRVEITEGILADECNALLCYFFRMPRQVFNAQKKAQSSTDSG

GSSGGS*SGSETPGTSESATPESS*GGSSGGSDKKYSIGLAIGTNSVGWAVITDEYKVPSKKFKVLGNTDRHSIK

KNLIGALLFDSGETAEATRLKRTARRRYTRRKNRICYLQEIFSNEMAKVDDSFFHRLEESFLVEEDKKHERHP

IFGNIVDEVAYHEKYPTIYHLRKKLVDSTDKADLRLIYLALAHMIKFRGHFLIEGDLNPDNSDVDKLFIQLVQ

TYNQLFEENPINASGVDAKAILSARLSKSRRLENLIAQLPGEKKNGLFGNLIALSLGLTPNFKSNFDLAEDAK

LQLSKDTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQEEFYKFIKPILEKMDGTEELLVKLNREDLLRKQRTFDNGS

IPHQIHLGELHAILRRQEDFYPFLKDNREKIEKILTFRIPYYVGPLARGNSRFAWMTRKSEETITPWNFEEVV

DKGASAQSFIERMTNFDKNLPNEKVLPKHSLLYEYFTVYNELTKVKYVTEGMRKPAFLSGEQKKAIVDLLFKT

NRKVTVKQLKEDYFKKIECFDSVEISGVEDRFNASLGTYHDLLKIIKDKDFLDNEENEDILEDIVLTLTLFED

REMIEERLKTYAHLFDDKVMKQLKRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVMGRHKPENIVIEMARENQTTQKGQ

KNSRERMKRIEEGIKELGSQILKEHPVENTQLQNEKLYLYYLQNGRDMYVDQELDINRLSDYDVDHIVPQSFL

KDDSIDNKVLTRSDKNRGKSDNVPSEEVVKKMKNYWRQLLNAKLITQRKFDNLTKAERGGLSELDKAGFIKRQ

LVETRQITKHVAQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANGEIRKRPLIETN

GETGEIWDKGRDFATVRKVLSMPQVNIVKKTEVQTGGFSKESILPKRNSDKLIARKKDWDPKKYGGFDSPTV

AYSVLVVAKVEKGKSKKLKSVKELLGITIMERSSFEKNPIDFLEAKGYKEVKKDLIIKLPKYSLFELENGRKR

MLASAGELQKGNELALPSKYVNFLYLASHYEKLKGSPEDNEQKQLFVEQHKHYLDEIIEQISEFSKRVILADA

NLDKVLSAYNKHRDKPIREQAENIIHLFTLTNLGAPAAFKYFDTTIDRKRYTSTKEVLDATLIHQSITGLY

ETRIDLSQLGGD*SGGS*PKKKRKV

ABE7.10: ecTadA$_{(wild-type)}$-(SGGS)$_2$-XTEN-(SGGS)$_2$-
ecTadA$_{(W23R\_H36L\_P48A\_R51L\_L84F\_A106V\_D108N\_H123Y\_S146C\_D147Y\_R152P\_E155V\_I156F\_K157N)}$-
(SGGS)$_2$-XTEN-(SGGS)$_2$_nCas9_SGGS_NLS (SEQ ID NO: 586)

MSEVEFSHEYWMRHALTLAKRAWDEREVPVGAVLVHNNRVIGEGWNRPIGRHDPTAHAEIMALRQGGLVMQNY

RLIDATLYVTLEPCVMCAGAMIHSRIGRVVFGARDAKTGAAGSLMDVLHHPGMNHRVEITEGILADECAALLS

DFFRMRRQEIKAQKKAQSSTDSGGSSGGS*SGSETPGTSESATPESS*GGSSGGSSEVEFSHEYWMRHALTLAKR

ARDEREVPVGAVLVLNNRVIGEGWNRAIGLHDPTAHAEIMALRQGGLVMQNYRLIDATLYVTFEPCVMCAGAM

IHSRIGRVVFGVRNAKTGAAGSLMDVLHYPGMNHRVEITEGILADECAALLCYFFRMPRQVFNAQKKAQSSTD

*SGGS*SGGS*SGSETPGTSESATPESS*GGSSGGSDKKYSIGLAIGTNSVGWAVITDEYKVPSKKFKVLGNTDRHS

IKKNLIGALLFDSGETAEATRLKRTARRRYTRRKNRICYLQEIFSNEMAKVDDSFFHRLEESFLVEEDKKHER

HPIFGNIVDEVAYHEKYPTIYHLRKKLVDSTDKADLRLIYLALAHMIKFRGHFLIEGDLNPDNSDVDKLFIQL

VQTYNQLFEENPINASGVDAKAILSARLSKSRRLENLIAQLPGEKKNGLFGNLIALSLGLTPNFKSNFDLAED

-continued

```
AKLQLSKDTYDDDLDNLLAQIGDQYADLFLAAKNLSDAILLSDILRVNTEITKAPLSASMIKRYDEHHQDLTL

LKALVRQQLPEKYKEIFFDQSKNGYAGYIDGGASQEEFYKFIKPILEKMDGTEELLVKLNREDLLRKQRTFDN

GSIPHQIHLGELHAILRRQEDFYPFLKDNREKIEKILTFRIPYYVGPLARGNSRFAWMTRKSEETITPWNFEE

VVDKGASAQSFIERMTNFDKNLPNEKVLPKHSLLYEYFTVYNELTKVKYVTEGMRKPAFLSGEQKKAIVDLLF

KTNRKVTVKQLKEDYFKKIECFDSVEISGVEDRFNASLGTYHDLLKIIKDKDFLDNEENEDILEDIVLTLTLF

EDREMIEERLKTYAHLFDDKVMKQLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVKVMGRHKPENIVIEMARENQTTQK

GQKNSRERMKRIEEGIKELGSQILKEHPVENTQLQNEKLYLYYLQNGRDMYVDQELDINRLSDYDVDHIVPQS

FLKDDSIDNKVLTRSDKNRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKVREINNYHHAHDAYLNA

VVGTALIKKYPKLESEFVYGDYKVYDVRKMIAKSEQEIGKATAKYFFYSNIMNFFKTEITLANGEIRKRPLIE

TNGETGEIVWDKGRDFATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLIIKLPKYSLFELENGR

KRMLASAGELQKGNELALPSKYVNFLYLASHYEKLKGSPEDNEQKQLFVEQHKHYLDEIIEQISEFSKRVILA

DANLDKVLSAYNKHRDKPIREQAENIIHLFTLTNLGAPAAFKYFDTTIDRKRYTSTKEVLDATLIHQSITGL

YETRIDLSQLGGDSGGSPKKKRKV
```

It should be appreciated that the fusion proteins of the present disclosure may comprise one or more additional features. For example, in some embodiments, the fusion protein may comprise cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of ordinary skill in the art. In some embodiments, the fusion protein comprises one or more His tags.

Additional suitable strategies for generating fusion proteins comprising a napDNAbp (e.g., a Cas9 domain) and a nucleic acid editing domain (e.g., a deaminase domain) will be apparent to those of ordinary skill in the art based on this disclosure in combination with the general knowledge in the art. Suitable strategies for generating fusion proteins according to aspects of this disclosure using linkers or without the use of linkers will also be apparent to those of ordinary skill in the art in view of the instant disclosure and the knowledge in the art. For example, Gilbert et al., CRISPR-mediated modular RNA-guided regulation of transcription in eukaryotes. *Cell.* 2013; 154(2):442-51, showed that C-terminal fusions of Cas9 with VP64 using 2 NLS's as a linker (SPKKKRKVEAS, SEQ ID NO: 522), can be employed for transcriptional activation. Mali et al. (CAS9 transcriptional activators for target specificity screening and paired nickases for cooperative genome engineering. *Nat Biotechnol.* 2013; 31(9):833-8), reported that C-terminal fusions with VP64 without linker can be employed for transcriptional activation. And Maeder et al. (CRISPR RNA-guided activation of endogenous human genes. *Nat Methods.* 2013; 10: 977-979), reported that C-terminal fusions with VP64 using a Gly$_4$Ser (SEQ ID NO: 313) linker can be used as transcriptional activators. Recently, dCas9-FokI nuclease fusions have successfully been generated and exhibit improved enzymatic specificity as compared to the parental Cas9 enzyme (In Guilinger J P, Thompson D B, Liu D R. Fusion of catalytically inactive Cas9 to FokI nuclease improves the specificity of genome modification. *Nat. Biotechnol.* 2014; 32(6): 577-82; and in Tsai S Q, et al. Dimeric CRISPR RNA-guided FokI nucleases for highly specific genome editing. *Nat Biotechnol.* 2014; 32(6):569-76. PMID: 24770325 a SGSETPGTSESATPES (SEQ ID NO: 306) or a GGGGS (SEQ ID NO: 313) linker was used in FokI-dCas9 fusion proteins, respectively).

EXAMPLES

In order that the invention described herein may be more fully understood, the following examples are set forth. The synthetic examples described in this application are offered to illustrate the compounds and methods provided herein and are not to be construed in any way as limiting their scope.

Example 1: Cas9 Variant Sequences

The disclosure provides Cas9 variants, for example Cas9 proteins from one or more organisms, which may comprise one or more mutations (e.g., to generate dCas9 or Cas9 nickase). In some embodiments, one or more of the amino acid residues, identified below by an asterisk, of a Cas9 protein may be mutated. In some embodiments, the D10 and/or H840 residues of the amino acid sequence provided in SEQ ID NO: 10, or a corresponding mutation in any of the amino acid sequences provided in SEQ ID NOs: 11-260, are mutated. In some embodiments, the D10 residue of the amino acid sequence provided in SEQ ID NO: 10, or a corresponding mutation in any of the amino acid sequences provided in SEQ ID NOs: 11-260, is mutated to any amino acid residue, except for D. In some embodiments, the D10 residue of the amino acid sequence provided in SEQ ID NO: 10, or a corresponding mutation in any of the amino acid sequences provided in SEQ ID NOs: 11-260, is mutated to an A. In some embodiments, the H840 residue of the amino acid sequence provided in SEQ ID NO: 10, or a corresponding residue in any of the amino acid sequences provided in SEQ ID NOs: 11-260, is an H. In some embodiments, the H840 residue of the amino acid sequence provided in SEQ ID NO: 10, or a corresponding mutation in any of the amino acid sequences provided in SEQ ID NOs: 11-260, is mutated to any amino acid residue, except for H. In some embodiments, the H840 residue of the amino acid sequence provided in SEQ ID NO: 10, or a corresponding mutation in any of the amino acid sequences provided in SEQ ID NOs: 11-260, is mutated to an A. In some embodiments, the D10 residue of the amino acid sequence provided in SEQ ID NO: 10, or a corresponding residue in any of the amino acid sequences provided in SEQ ID NOs: 11-260, is a D.

A number of Cas9 sequences from various species were aligned to determine whether corresponding homologous amino acid residues of D10 and H840 of SEQ ID NO: 10 or SEQ ID NO: 11 can be identified in other Cas9 proteins, allowing the generation of Cas9 variants with corresponding mutations of the homologous amino acid residues. The alignment was carried out using the NCBI Constraint-based Multiple Alignment Tool (COBALT (accessible at st-va.ncbi.nlm.nih.gov/tools/cobalt), with the following parameters. Alignment parameters: Gap penalties -11,-1; End-Gap penalties -5,-1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular. An alignment of all homologous Cas9 proteins, allowing the generation of Cas9 variants with corresponding mutations of the homologous amino acid residues, is shown in, e.g., Patent Publication No. WO2017/070632, published Apr. 27, 2017, entitled "Nucleobase editors and uses thereof"; which is incorporated by reference herein.

An exemplary alignment of four Cas9 sequences is provided below. The Cas9 sequences in the alignment are: Sequence 1 (S1): SEQ ID NO: 11|WP_010922251| gi 499224711|type II CRISPR RNA-guided endonuclease Cas9 [*Streptococcus pyogenes*]; Sequence 2 (S2): SEQ ID NO: 12|WP_039695303|gi 746743737|type II CRISPR RNA-guided endonuclease Cas9 [*Streptococcus gallolyticus*]; Sequence 3 (S3): SEQ ID NO: 13|WP_045635197|gi 782887988|type II CRISPR RNA-guided endonuclease Cas9 [*Streptococcus mitis*]; Sequence 4 (S4): SEQ ID NO: 14| 5AXW_A|gi 924443546| *Staphylococcus aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

```
S1      1  --MDKK-YSIGLD*IGTNSVGWAVITDEYKVPSKKFKVLGNTDRHSIKKNLI--GALLFDSG--ETAEATRLKRTARRRYT   73
S2      1  --MTKKNYSIGLD*IGTNSVGWAVITDDYKVPAKKMKVLGNTDKKYIKKNLL--GALLFDSG--ETAEATRLKRTARRRYT   74
S3      1  --M-KKGYSIGLD*IGTNSVGFAVITDDYKVPSKKMKVLGNTDKRFIKKNLI--GALLFDEG--TTAEARRLKRTARRRYT   73
S4      1  GSHMKRNYILGLD*IGITSVGYGII--DYET----------------RDVIDAGVRLFKEANVENNEGRRSKRGARRLKR   61

S1     74  RRKNRICYLQEIFSNEMAKVDDSFEHRLEESFLVEEDKKHERHPIFGNIVDEVAYHEKYPTIYHLRKKLVDSTDKADLRL  153
S2     75  RRKNRLRYLQEIFANEIAKVDESFFQRLDESFLTDDDKTFDSHPIFGNKAEEDAYHQKFPTIYHLRKHLADSSEKADLRL  154
S3     74  RRKNRLRYLQEIFSEEMSKVDSSFFHRLDDSFLIPEDKRESKYPIFATLTEEKEYHKQFPTIYHLRKQLADSKEKTDLRL  153
S4     62  RRRHRIQRVKKLL--------------FDYNLLTD-------------------HSELSGINPYEARVEGLSQXLSEEE  107

S1    154  IYLALAHMIKFRGHFLIEGDLNPDNSDVDKLFIQLVQTYNQLFEENPINASGVDAKAILSARLSKSRRLENLIAQLPGEK  233
S2    155  VYLALAHMIKFRGHFLIEGELNAENTDVQKIFADFVGVYNRTFDDSHLSEITVDVASILTEKISKSRRLENLIKYYPTEK  234
S3    154  IYLALAHMIKYRGHFLYEEAFDIKNNDIQKIFNEFISIYDNTFEGSSLSGQNAQVEAIFTDKISKSAKRERVLKLFPDEK  233
S4    108  FSAALLHLAKRRG--------------------VHNVNEVEEDT-----------------------------------  131

S1    234  KNGLFGNLIALSLGLTPNFKSNFDLAEDAKLQLSKDTYDDDLDNLLAQIGDQYADLFLAAKNLSDAILLSDILRVNTEIT  313
S2    235  KNTLFGNLIALALGLQPNFKTNFKLSEDAKLQFSKDTYEEDLEELLGKIGDDYADLFTSAKNLYDAILLSGILTVDDNST  314
S3    234  STGLFSEFLKLIVGNQADFKKHFDLEDKAPLQFSKDTYDEDLENLLGQIGDDFTDLFVSAKKLYDAILLSGILTVTDPST  313
S4    132  -----GNELS------------------THEQISRN--------------------------------------------  144

S1    314  KAPLSASMIKRYDEHHQDLTLLKALVRQQLPEKYKEIFFDQSKNGYAGYIDGGASQEEFYKFIKPILEKM--DGTEELLV  391
S2    315  KAPLSASMIKRYVEHHEDLEKLKEFIKANKSELYHDIFKDKNKNGYAGYIENGVKQDEFYKYLKNILSKIKIDGSDYFLD  394
S3    314  KAPLSASMIERYENHQNDLAALKQFIKNNLPEKYDEVFSDQSKDGYAGYIDGKTTQETFYKYIKNLLSKF--EGTDYFLD  391
S4    145  ----SKALEEKYVAELQ-----------------------------------LERLKKDG------                165

S1    392  KLNREDLLRKQRTFDNGSIPHQIHLGELHAILRRQEDFYPFLKDNREKIEKILTFRIPYYVGPLARGNSRFAWMTRKSEE  471
S2    395  KIEREDFLRKQRTFDNGSIPHQIHLQEMHAILRRQGDYYPFLKEKQDRIEKILTFRIPYYVGPLVRKDSRFAWAEYRSDE  474
S3    392  KIEREDFLRKQRTFDNGSIPHQIHLQEMNAILRRQGEYYPFLKDNKEKIEKILTFRIPYYVGPLARGNRDFAWLTRNSDE  471
S4    166  --EVRGSINRFKTSD--------YVKEAKQLLKVQKAYHQLDQSFIDTYIDLLETRRTYYEGP--GEGSPFGW------K  227

S1    472  TITPWNFEEVVDKGASAQSFIERMTNFDKNLPNEKVLPKHSLLYEYFTVYNELTKVKYVTEGMRKPAFLSGEQKKAIVDL  551
S2    475  KITPWNFDKVIDKEKSAEKFITRMTLNDLYLPEEKVLPKHSHVYETYAVYNELTKIKYVNEQGKE-SFFDSNMKQEIFDH  553
S3    472  AIRPWNFEEIVDKASSAEDFINKMTNYDLYLPEEKVLPKHSLLYETFAVYNELTKVKFIAEGLRDYQFLDSGQKKQIVNQ  551
S4    228  DIKEW-------------YEMLMGHCTYFPEELRSVKYAYNADLYNALNDLNNLVITRDENEK---LEYYEKFQIIEN   289

S1    552  LFKTNRKVTVKQLKEDYFKKIECFDSVEISGVEDR---FNASLGTYHDLLKIIKDKDFLDNEENEDILEDIVLTLTLFED  628
S2    554  VFKENRKVTKEKLLNYLNKEFPEYRIKDLIGLDKENKSFNASLGTYHDLKKIL-DKAFLDDKVNEEVIEDIIKTLTLFED  632
S3    552  LFKENRKVTEKDIIHYLHN-VDGYDGIELKGIEKQ---FNALSTYHDLLKIIKDKEFMDDAKNEAILENIVHTLTIFED   627
S4    290  VFKQKKKPTLKQIAKEILVNEEDIKGYRVTSTGKPEF---TNLKVYHDIKDITARKEIII---ENAELLDQIAKILTIYQS  363

S1    629  REMIEERLKTYAHLFDDKVMKQLKR-RRYTGWGRLSRKLINGIRDKQSGKTILDFLKSDGFANRNFMQLIHDDSLTFKED  707
S2    633  KDMIHERLQKYSDIFTANQLKKLER-RHYTGWGRLSYKLINGIRNKENNKTILDYLIDDGSANRNFMQLINDDTLPFKQI  711
S3    628  REMIKQRLAQYDSLFDEKVIKALTR-RHYTGWGKLSAKLINGICDKQTGNTILDYLIDDGKINRNFMQLINDDGLSFKEI  706
S4    364  SEDIQEELTNLNSELTQEEIEQISNLKGYTGTHNLSLKAINLILDE------LWHTNDNQIAIFNRLKLVP---------  428
```

```
S1   708  IQKAQVSGQGDSLHEHIANLAGSPAIKKGILQTVKVVDELVKVMGRHKPENIVIEMARENQTT------QKGQKNSRERM   781
S2   712  IQKSQVVGDVDDIEAVVHDLPGSPAIKKGILQSVKIVDELVKVMG-GNPDNIVIEMARENQTT------NRGRSQSQQRL   784
S3   707  IQKAQVIGKTDDVKQVVQELSGSPAIKKGILQSIKIVDELVKVMG-HAPESIVIEMARENQTT------ARGKKNSQQRY   779
S4   429  -KKVDLSQQKEIPTTLVDDFILSPVVKRSFIQSIKVINAIIKKYG--LPNDIIIELAREKNSKDAQKMINEMQKRNRQTN   505

S1   782  KRIEEGIKELGSQIL--------KEHPVENTQLQNEKLYLYYLQNGRDMYVDQELDINRLSD----YDVDH*IVPQSFLKDD   850
S2   785  KKLQNSLKELGSNILNEEKPSYIEDKVENSHLQNDQLFLYYIQNGKDMYTGDELDIDHLSD----YDIDH*IIPQAFIKDD   860
S3   780  KRIEDSLKILASGL---DSNILKENPTDNNQLQNDRLFLYYLQNGKDMYTGEALDINQLSS----YDIDH*IIPQAFIKDD   852
S4   506  ERIEEIIRTTGK---------------ENAKYLIEKIKLHDMQEGKCLYSLEAIPLEDLLNNPFNYEVDH*IIPRSVSFDN   570

S1   851  SIDNKVLTRSDKNRGKSDNVPSEEVVKKMKNYWRQLLNAKLITQRKFDN-LTKAERGGL-SELD------KAGFIKRQLV   922
S2   861  SIDNRVLTSSAKNRGKSDDVPSLDIVRARKAEWVRLYKSGLISKRKFDN-LTKAERGGL-TEAD------KAGFIKRQLV   932
S3   853  SLDNRVLTSSKDNRGKSDNVPSIEVVQKRKAFWQQLLDSKLISERKFNN-LTKAERGGL-DERD------KVGFIKRQLV   924
S4   571  SFNNKVLVKQEEASKKGNRTPFQYLSSSDSKISYETFKKHILNLAKGKGRISKTKKEYLLEERDINRFSVQKDFINRNLV   650

S1   923  ETRQITKHVAQILDSRMNTKYDENDKLIREVKVITLKSKLVSDFRKDFQFYKVREINNYHHAHDAYLNAVVGTALIKKYP   1002
S2   933  ETRQITKHVAQILDARFNTEHDENDKVIRDVKVITLKSNLVSQFRKDFEFYKVREINDYHHAHDAYLNAVVGTALLKKYP   1012
S3   925  ETRQITKHVAQILDARYNTEVNEKDKKNRTVKIITLKSNLVSNFRKEFRLYKVREINDYHHAHDAYLNAVVAKAILKKYP   1004
S4   651  DTRYATRGLMNLLRSYFRVN-------NLDVKVKSINGGFTSFLRRKWKFKKERNKGYKHHAEDALIIA----------   712

S1  1003  KLESEFVYGDYKVYDVRKMIAKSEQ--EIGKATAKYFFYSNIMNFFKTEITLANGEIRKRPLIETNGETGEIVWDKG---   1077
S2  1013  KLASEFVYGEYKKYDTRKFITNSSD-----KATAKYFFYSNTMNFFTKVKYADGTVFERPLIETNAD-GETAWNKQ---   1083
S3  1005  KLEPEFVYGEYQKYDLKRYISRSKDPKEVEKATEKYFFYSNLLNFFKEEVHYADGTIVKRENIEYSKDTGEIAWNKE---   1081
S4   713  --NADFIFKEWKKLDKAKKVMENQM-----------------------FEEKQAESMPEIETEQEYKEIFITPHQIK    764

S1  1078  -----RDFATVRKVLSMPQVNIVKKTEVQTGGFSKESILPKRNSDKLIARKKD---WDPKKYGGFDSPTVAYSVLVVAKV   1149
S2  1084  -----IDFEKVRKVLSYPQVNIVKKVETQTGGFSKESILPKGDSDKLIPRKTKKVYWDTKKYGGFDSPTVAYSVFVVADV   1158
S3  1082  -----KDFAIIKKVLSLPQVNIVKKREVQTGGFSKESILPKGNSDKLIPRKTKDILLDTTKYGGFDSPVIAYSILLIADI   1156
S4   765  HIKDFKDYKYSHRVDKKPNRELINDTLYSTRKDDKGNTLIVNNLNGLYDKDNDKL----KKLIN-KSP----EKLLMYHH   835

S1  1150  EKGKSKKLKSVKELLGITIMERSSFEKNPI-DFLEAKG-----YKEVKKDLIIKLPKYSLFELENGRKRMLASAGELQKG   1223
S2  1159  EKGKAKKLKTVKELVGISIMERSFFEENPV-EFLENKG-----YHNIREDKLIKLPKYSLFEFEGGRRRLLASASELQKG   1232
S3  1157  EKGKAKKLKTVKTLVGITIMEKAAFEENPI-TFLENKG-----YHNVRKENILCLPKYSLFELENGRRRLLASAKELQKG   1230
S4   836  DPQTYQKLK--------LIMEQYGDEKNPLYKYYEETGNYLTKYSKKDNGPVIKKIKYYGNKLNAHLDITDDYPNSRNKV   907

S1  1224  NELALPSKYVNFLYLASHYEKLKGSPEDNEQKQLFVEQHKHYLDEIIEQISEFSKRVILADANLDKVLSAYNKH------   1297
S2  1233  NEMVLPGYLVELLYHAHRADNF-----NSTEYLNYVSEHKKEFEKVLSCVEDFANLYVDVEKNLSKIRAVADSM------   1301
S3  1231  NEIVLPVYLTTLLYHSKNVHKL-----DEPGHLEYIQKHRNEFKDLLNLVSEFSQKYVLADANLEKIKSLYADN------   1299
S4   908  VKLSLKPYRFD-VYLDNGVYKFV-----TVKNLDVIK--KENYYEVNSKAYEEAKKLKKISNQAEFIASFYNNDLIKING   979

S1  1298  RDKPIREQAENIIHLFTLTNLGAPAAFKYFDTTIDRKRYTSTKEVLDATLIHQSIT--------GLYETRI----DLSQL   1365
S2  1302  DNFSIEEISNSFINLLTLTALGAPADFNFLGEKIPRKRYTSTKECLNATLIHQSIT--------GLYETRI----DLSEL   1369
S3  1300  EQADIEILANSFINLLTFTALGAPAAFKFFGKDIDRKRYTTVSEILNATLIHQSIT--------GLYETWI----DLSEL   1367
S4   980  ELYRVIGVNNDLLNRIEVNMIDITYR-EYLENMNDKRPPRIIKTIASKT---QSIKKYSTDILGNLYEVKSKKHPQIIKK   1055

S1  1366  GGD   1368
S2  1370  GEE   1372
S3  1368  GED   1370
S4  1056  G--   1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 11-14 (e.g., S1, S2, S3, and S4, respectively) are mutated as described herein. The residues D10 and H840 in Cas9 of SEQ ID NO: 10 that correspond to the residues identified in SEQ ID NOs: 11-14 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 10 herein, e.g., mutations of residues 10, and 840 in SEQ ID NO: 10, are referred to herein as "homologous" or "corresponding" mutations. For example, the mutations corresponding to the D10A mutation in SEQ ID NO: 10 or S1 (SEQ ID NO: 11) for the four aligned sequences above are D11A for S2, D10A for S3, and D13A for S4; the corresponding mutations for H840A in SEQ ID NO: 10 or S1 (SEQ ID NO: 11) are H850A for S2, H842A for S3, and H560A for S4.

A total of 250 Cas9 sequences (SEQ ID NOs: 11-260) from different species were aligned using the same algorithm and alignment parameters outlined above, and is shown in e.g., Patent Publication No. WO2017/070632, published Apr. 27, 2017, entitled "Nucleobase editors and uses thereof"; which is incorporated by reference herein.

WP_010922251.1 type II CRISPR RNA-guided endonuclease Cas9 [*Streptococcus pyogenes*] SEQ ID NO: 11
WP_039695303.1 type II CRISPR RNA-guided endonuclease Cas9 [*Streptococcus gallolyticus*] SEQ ID NO: 12
WP_045635197.1 type II CRISPR RNA-guided endonuclease Cas9 [*Streptococcus mitis*] SEQ ID NO: 13
5AXW_A Cas9, Chain A, Crystal Structure [*Staphylococcus Aureus*] SEQ ID NO: 14
WP_009880683.1 type II CRISPR RNA-guided endonuclease Cas9 [*Streptococcus pyogenes*] SEQ ID NO: 15
WP_010922251.1 type II CRISPR RNA-guided endonuclease Cas9 [*Streptococcus pyogenes*] SEQ ID NO: 16
WP_011054416.1 type II CRISPR RNA-guided endonuclease Cas9 [*Streptococcus pyogenes*] SEQ ID NO: 17
WP_011284745.1 type II CRISPR RNA-guided endonuclease Cas9 [*Streptococcus pyogenes*] SEQ ID NO: 18
WP_011285506.1 type II CRISPR RNA-guided endonuclease Cas9 [*Streptococcus pyogenes*] SEQ ID NO: 19
WP_011527619.1 type II CRISPR RNA-guided endonuclease Cas9 [*Streptococcus pyogenes*] SEQ ID NO: 20
WP_012560673.1 type II CRISPR RNA-guided endonuclease Cas9 [*Streptococcus pyogenes*] SEQ ID NO: 21
WP_014407541.1 type II CRISPR RNA-guided endonuclease Cas9 [*Streptococcus pyogenes*] SEQ ID NO: 22
WP_020905136.1 type II CRISPR RNA-guided endonuclease Cas9 [*Streptococcus pyogenes*] SEQ ID NO: 23
WP_023080005.1 type II CRISPR RNA-guided endonuclease Cas9 [*Streptococcus pyogenes*] SEQ ID NO: 24
WP_023610282.1 type II CRISPR RNA-guided endonuclease Cas9 [*Streptococcus pyogenes*] SEQ ID NO: 25
WP_030125963.1 type II CRISPR RNA-guided endonuclease Cas9 [*Streptococcus pyogenes*] SEQ ID NO: 26
WP_030126706.1 type II CRISPR RNA-guided endonuclease Cas9 [*Streptococcus pyogenes*] SEQ ID NO: 27
WP_031488318.1 type II CRISPR RNA-guided endonuclease Cas9 [*Streptococcus pyogenes*] SEQ ID NO: 28
WP_032460140.1 type II CRISPR RNA-guided endonuclease Cas9 [*Streptococcus pyogenes*] SEQ ID NO: 29
WP_032461047.1 type II CRISPR RNA-guided endonuclease Cas9 [*Streptococcus pyogenes*] SEQ ID NO: 30
WP_032462016.1 type II CRISPR RNA-guided endonuclease Cas9 [*Streptococcus pyogenes*] SEQ ID NO: 31
WP_032462936.1 type II CRISPR RNA-guided endonuclease Cas9 [*Streptococcus pyogenes*] SEQ ID NO: 32
WP_032464890.1 type II CRISPR RNA-guided endonuclease Cas9 [*Streptococcus pyogenes*] SEQ ID NO: 33
WP_033888930.1 type II CRISPR RNA-guided endonuclease Cas9 [*Streptococcus pyogenes*] SEQ ID NO: 34
WP_038431314.1 type II CRISPR RNA-guided endonuclease Cas9 [*Streptococcus pyogenes*] SEQ ID NO: 35
WP_038432938.1 type II CRISPR RNA-guided endonuclease Cas9 [*Streptococcus pyogenes*] SEQ ID NO: 36
WP_038434062.1 type II CRISPR RNA-guided endonuclease Cas9 [*Streptococcus pyogenes*] SEQ ID NO: 37
BAQ51233.1 CRISPR-associated protein, Csn1 family [*Streptococcus pyogenes*] SEQ ID NO: 38
KGE60162.1 hypothetical protein MGAS2111_0903 [*Streptococcus pyogenes MGAS*2111] SEQ ID NO: 39
KGE60856.1 CRISPR-associated endonuclease protein [*Streptococcus pyogenes SS*1447] SEQ ID NO: 40
WP_002989955.1 MULTISPECIES: type II CRISPR RNA-guided endonuclease Cas9 [*Streptococcus*] SEQ ID NO: 41
WP_003030002.1 MULTISPECIES: type II CRISPR RNA-guided endonuclease Cas9 [*Streptococcus*] SEQ ID NO: 42
WP_003065552.1 MULTISPECIES: type II CRISPR RNA-guided endonuclease Cas9 [*Streptococcus*] SEQ ID NO: 43
WP_001040076.1 type II CRISPR RNA-guided endonuclease Cas9 [*Streptococcus agalactiae*] SEQ ID NO: 44
WP_001040078.1 type II CRISPR RNA-guided endonuclease Cas9 [*Streptococcus agalactiae*] SEQ ID NO: 45
WP_001040080.1 type II CRISPR RNA-guided endonuclease Cas9 [*Streptococcus agalactiae*] SEQ ID NO: 46
WP_001040081.1 type II CRISPR RNA-guided endonuclease Cas9 [*Streptococcus agalactiae*] SEQ ID NO: 47
WP_001040083.1 type II CRISPR RNA-guided endonuclease Cas9 [*Streptococcus agalactiae*] SEQ ID NO: 48
WP_001040085.1 type II CRISPR RNA-guided endonuclease Cas9 [*Streptococcus agalactiae*] SEQ ID NO: 49
WP_001040087.1 type II CRISPR RNA-guided endonuclease Cas9 [*Streptococcus agalactiae*] SEQ ID NO: 50
WP_001040088.1 type II CRISPR RNA-guided endonuclease Cas9 [*Streptococcus agalactiae*] SEQ ID NO: 51
WP_001040089.1 type II CRISPR RNA-guided endonuclease Cas9 [*Streptococcus agalactiae*] SEQ ID NO: 52
WP_001040090.1 type II CRISPR RNA-guided endonuclease Cas9 [*Streptococcus agalactiae*] SEQ ID NO: 53
WP_001040091.1 type II CRISPR RNA-guided endonuclease Cas9 [*Streptococcus agalactiae*] SEQ ID NO: 54
WP_001040092.1 type II CRISPR RNA-guided endonuclease Cas9 [*Streptococcus agalactiae*] SEQ ID NO: 55
WP_001040094.1 type II CRISPR RNA-guided endonuclease Cas9 [*Streptococcus agalactiae*] SEQ ID NO: 56
WP_001040095.1 type II CRISPR RNA-guided endonuclease Cas9 [*Streptococcus agalactiae*] SEQ ID NO: 57
WP_001040096.1 type II CRISPR RNA-guided endonuclease Cas9 [*Streptococcus agalactiae*] SEQ ID NO: 58
WP_001040097.1 type II CRISPR RNA-guided endonuclease Cas9 [*Streptococcus agalactiae*] SEQ ID NO: 59
WP_001040098.1 type II CRISPR RNA-guided endonuclease Cas9 [*Streptococcus agalactiae*] SEQ ID NO: 60
WP_001040099.1 type II CRISPR RNA-guided endonuclease Cas9 [*Streptococcus agalactiae*] SEQ ID NO: 61
WP_001040100.1 type II CRISPR RNA-guided endonuclease Cas9 [*Streptococcus agalactiae*] SEQ ID NO: 62
WP_001040104.1 type II CRISPR RNA-guided endonuclease Cas9 [*Streptococcus agalactiae*] SEQ ID NO: 63
WP_001040105.1 type II CRISPR RNA-guided endonuclease Cas9 [*Streptococcus agalactiae*] SEQ ID NO: 64
WP_001040106.1 type II CRISPR RNA-guided endonuclease Cas9 [*Streptococcus agalactiae*] SEQ ID NO: 65
WP_001040107.1 type II CRISPR RNA-guided endonuclease Cas9 [*Streptococcus agalactiae*] SEQ ID NO: 66
WP_001040108.1 type II CRISPR RNA-guided endonuclease Cas9 [*Streptococcus agalactiae*] SEQ ID NO: 67

WP_001040109.1 type II CRISPR RNA-guided endonuclease Cas9 [*Streptococcus agalactiae*] SEQ ID NO: 68
WP_001040110.1 type II CRISPR RNA-guided endonuclease Cas9 [*Streptococcus agalactiae*] SEQ ID NO: 69
WP_015058523.1 type II CRISPR RNA-guided endonuclease Cas9 [*Streptococcus agalactiae*] SEQ ID NO: 70
WP_017643650.1 type II CRISPR RNA-guided endonuclease Cas9 [*Streptococcus agalactiae*] SEQ ID NO: 71
WP_017647151.1 type II CRISPR RNA-guided endonuclease Cas9 [*Streptococcus agalactiae*] SEQ ID NO: 72
WP_017648376.1 type II CRISPR RNA-guided endonuclease Cas9 [*Streptococcus agalactiae*] SEQ ID NO: 73
WP_017649527.1 type II CRISPR RNA-guided endonuclease Cas9 [*Streptococcus agalactiae*] SEQ ID NO: 74
WP_017771611.1 type II CRISPR RNA-guided endonuclease Cas9 [*Streptococcus agalactiae*] SEQ ID NO: 75
WP_017771984.1 type II CRISPR RNA-guided endonuclease Cas9 [*Streptococcus agalactiae*] SEQ ID NO: 76
CFQ25032.1 CRISPR-associated protein [*Streptococcus agalactiae*] SEQ ID NO: 77
CFV16040.1 CRISPR-associated protein [*Streptococcus agalactiae*] SEQ ID NO: 78
KLJ37842.1 CRISPR-associated protein Csn1 [*Streptococcus agalactiae*] SEQ ID NO: 79
KLJ72361.1 CRISPR-associated protein Csn1 [*Streptococcus agalactiae*] SEQ ID NO: 80
KLL20707.1 CRISPR-associated protein Csn1 [*Streptococcus agalactiae*] SEQ ID NO: 81
KLL42645.1 CRISPR-associated protein Csn1 [*Streptococcus agalactiae*] SEQ ID NO: 82
WP_047207273.1 type II CRISPR RNA-guided endonuclease Cas9 [*Streptococcus agalactiae*] SEQ ID NO: 83
WP_047209694.1 type II CRISPR RNA-guided endonuclease Cas9 [*Streptococcus agalactiae*] SEQ ID NO: 84
WP_050198062.1 type II CRISPR RNA-guided endonuclease Cas9 [*Streptococcus agalactiae*] SEQ ID NO: 85
WP_050201642.1 type II CRISPR RNA-guided endonuclease Cas9 [*Streptococcus agalactiae*] SEQ ID NO: 86
WP_050204027.1 type II CRISPR RNA-guided endonuclease Cas9 [*Streptococcus agalactiae*] SEQ ID NO: 87
WP_050881965.1 type II CRISPR RNA-guided endonuclease Cas9 [*Streptococcus agalactiae*] SEQ ID NO: 88
WP_050886065.1 type II CRISPR RNA-guided endonuclease Cas9 [*Streptococcus agalactiae*] SEQ ID NO: 89
AHN30376.1 CRISPR-associated protein Csn1 [*Streptococcus agalactiae* 138P] SEQ ID NO: 90
EAO78426.1 reticulocyte binding protein [*Streptococcus agalactiae* H36B] SEQ ID NO: 91
CCW42055.1 CRISPR-associated protein, SAG0894 family [*Streptococcus agalactiae* ILRI112] SEQ ID NO: 92
WP_003041502.1 type II CRISPR RNA-guided endonuclease Cas9 [*Streptococcus anginosus*] SEQ ID NO: 93
WP_037593752.1 type II CRISPR RNA-guided endonuclease Cas9 [*Streptococcus anginosus*] SEQ ID NO: 94
WP_049516684.1 CRISPR-associated protein Csn1 [*Streptococcus anginosus*] SEQ ID NO: 95
GAD46167.1 hypothetical protein ANG6_0662 [*Streptococcus anginosus* T5] SEQ ID NO: 96
WP_018363470.1 type II CRISPR RNA-guided endonuclease Cas9 [*Streptococcus caballi*] SEQ ID NO: 97
WP_003043819.1 type II CRISPR RNA-guided endonuclease Cas9 [*Streptococcus canis*] SEQ ID NO: 98
WP_006269658.1 type II CRISPR RNA-guided endonuclease Cas9 [*Streptococcus constellatus*] SEQ ID NO: 99
WP_048800889.1 type II CRISPR RNA-guided endonuclease Cas9 [*Streptococcus constellatus*] SEQ ID NO: 100
WP_012767106.1 type II CRISPR RNA-guided endonuclease Cas9 [*Streptococcus dysgalactiae*] SEQ ID NO: 101
WP_014612333.1 type II CRISPR RNA-guided endonuclease Cas9 [*Streptococcus dysgalactiae*] SEQ ID NO: 102
WP_015017095.1 type II CRISPR RNA-guided endonuclease Cas9 [*Streptococcus dysgalactiae*] SEQ ID NO: 103
WP_015057649.1 type II CRISPR RNA-guided endonuclease Cas9 [*Streptococcus dysgalactiae*] SEQ ID NO: 104
WP_048327215.1 type II CRISPR RNA-guided endonuclease Cas9 [*Streptococcus dysgalactiae*] SEQ ID NO: 105
WP_049519324.1 CRISPR-associated protein Csn1 [*Streptococcus dysgalactiae*] SEQ ID NO: 106
WP_012515931.1 type II CRISPR RNA-guided endonuclease Cas9 [*Streptococcus equi*] SEQ ID NO: 107
WP_021320964.1 type II CRISPR RNA-guided endonuclease Cas9 [*Streptococcus equi*] SEQ ID NO: 108
WP_037581760.1 type II CRISPR RNA-guided endonuclease Cas9 [*Streptococcus equi*] SEQ ID NO: 109
WP_004232481.1 type II CRISPR RNA-guided endonuclease Cas9 [*Streptococcus* equinus] SEQ ID NO: 110
WP_009854540.1 type II CRISPR RNA-guided endonuclease Cas9 [*Streptococcus* gallolyticus] SEQ ID NO: 111
WP_012962174.1 type II CRISPR RNA-guided endonuclease Cas9 [*Streptococcus* gallolyticus] SEQ ID NO: 112
WP_039695303.1 type II CRISPR RNA-guided endonuclease Cas9 [*Streptococcus* gallolyticus] SEQ ID NO: 113
WP_014334983.1 type II CRISPR RNA-guided endonuclease Cas9 [*Streptococcus* infantarius] SEQ ID NO: 114
WP_003099269.1 type II CRISPR RNA-guided endonuclease Cas9 [*Streptococcus iniae*] SEQ ID NO: 115
AHY15608.1 CRISPR-associated protein Csn1 [*Streptococcus iniae*] SEQ ID NO: 116
AHY17476.1 CRISPR-associated protein Csn1 [*Streptococcus iniae*] SEQ ID NO: 117
ESR09100.1 hypothetical protein IUSA1_08595 [*Streptococcus iniae* IUSA1] SEQ ID NO: 118
AGM98575.1 CRISPR-associated protein Cas9/Csn1, subtype II/NMEMI [*Streptococcus iniae* SF1] SEQ ID NO: 119
ALF27331.1 CRISPR-associated protein Csn1 [*Streptococcus intermedius*] SEQ ID NO: 120
WP_018372492.1 type II CRISPR RNA-guided endonuclease Cas9 [*Streptococcus massiliensis*] SEQ ID NO: 121
WP_045618028.1 type II CRISPR RNA-guided endonuclease Cas9 [*Streptococcus mitis*] SEQ ID NO: 122
WP_045635197.1 type II CRISPR RNA-guided endonuclease Cas9 [*Streptococcus mitis*] SEQ ID NO: 123
WP_002263549.1 type II CRISPR RNA-guided endonuclease Cas9 [*Streptococcus mutans*] SEQ ID NO: 124
WP_002263887.1 type II CRISPR RNA-guided endonuclease Cas9 [*Streptococcus mutans*] SEQ ID NO: 125
WP_002264920.1 type II CRISPR RNA-guided endonuclease Cas9 [*Streptococcus mutans*] SEQ ID NO: 126
WP_002269043.1 type II CRISPR RNA-guided endonuclease Cas9 [*Streptococcus mutans*] SEQ ID NO: 127
WP_002269448.1 type II CRISPR RNA-guided endonuclease Cas9 [*Streptococcus mutans*] SEQ ID NO: 128
WP_002271977.1 type II CRISPR RNA-guided endonuclease Cas9 [*Streptococcus mutans*] SEQ ID NO: 129
WP_002272766.1 type II CRISPR RNA-guided endonuclease Cas9 [*Streptococcus mutans*] SEQ ID NO: 130
WP_002273241.1 type II CRISPR RNA-guided endonuclease Cas9 [*Streptococcus mutans*] SEQ ID NO: 131
WP_002275430.1 type II CRISPR RNA-guided endonuclease Cas9 [*Streptococcus mutans*] SEQ ID NO: 132
WP_002276448.1 type II CRISPR RNA-guided endonuclease Cas9 [*Streptococcus mutans*] SEQ ID NO: 133

WP_002277050.1 type II CRISPR RNA-guided endonuclease Cas9 [*Streptococcus mutans*] SEQ ID NO: 134
WP_002277364.1 type II CRISPR RNA-guided endonuclease Cas9 [*Streptococcus mutans*] SEQ ID NO: 135
WP_002279025.1 type II CRISPR RNA-guided endonuclease Cas9 [*Streptococcus mutans*] SEQ ID NO: 136
WP_002279859.1 type II CRISPR RNA-guided endonuclease Cas9 [*Streptococcus mutans*] SEQ ID NO: 137
WP_002280230.1 type II CRISPR RNA-guided endonuclease Cas9 [*Streptococcus mutans*] SEQ ID NO: 138
WP_002281696.1 type II CRISPR RNA-guided endonuclease Cas9 [*Streptococcus mutans*] SEQ ID NO: 139
WP_002282247.1 type II CRISPR RNA-guided endonuclease Cas9 [*Streptococcus mutans*] SEQ ID NO: 140
WP_002282906.1 type II CRISPR RNA-guided endonuclease Cas9 [*Streptococcus mutans*] SEQ ID NO: 141
WP_002283846.1 type II CRISPR RNA-guided endonuclease Cas9 [*Streptococcus mutans*] SEQ ID NO: 142
WP_002287255.1 type II CRISPR RNA-guided endonuclease Cas9 [*Streptococcus mutans*] SEQ ID NO: 143
WP_002288990.1 type II CRISPR RNA-guided endonuclease Cas9 [*Streptococcus mutans*] SEQ ID NO: 144
WP_002289641.1 type II CRISPR RNA-guided endonuclease Cas9 [*Streptococcus mutans*] SEQ ID NO: 145
WP_002290427.1 type II CRISPR RNA-guided endonuclease Cas9 [*Streptococcus mutans*] SEQ ID NO: 146
WP_002295753.1 type II CRISPR RNA-guided endonuclease Cas9 [*Streptococcus mutans*] SEQ ID NO: 147
WP_002296423.1 type II CRISPR RNA-guided endonuclease Cas9 [*Streptococcus mutans*] SEQ ID NO: 148
WP_002304487.1 type II CRISPR RNA-guided endonuclease Cas9 [*Streptococcus mutans*] SEQ ID NO: 149
WP_002305844.1 type II CRISPR RNA-guided endonuclease Cas9 [*Streptococcus mutans*] SEQ ID NO: 150
WP_002307203.1 type II CRISPR RNA-guided endonuclease Cas9 [*Streptococcus mutans*] SEQ ID NO: 151
WP_002310390.1 type II CRISPR RNA-guided endonuclease Cas9 [*Streptococcus mutans*] SEQ ID NO: 152
WP_002352408.1 type II CRISPR RNA-guided endonuclease Cas9 [*Streptococcus mutans*] SEQ ID NO: 153
WP_012997688.1 type II CRISPR RNA-guided endonuclease Cas9 [*Streptococcus mutans*] SEQ ID NO: 154
WP_014677909.1 type II CRISPR RNA-guided endonuclease Cas9 [*Streptococcus mutans*] SEQ ID NO: 155
WP_019312892.1 type II CRISPR RNA-guided endonuclease Cas9 [*Streptococcus mutans*] SEQ ID NO: 156
WP_019313659.1 type II CRISPR RNA-guided endonuclease Cas9 [*Streptococcus mutans*] SEQ ID NO: 157
WP_019314093.1 type II CRISPR RNA-guided endonuclease Cas9 [*Streptococcus mutans*] SEQ ID NO: 158
WP_019315370.1 type II CRISPR RNA-guided endonuclease Cas9 [*Streptococcus mutans*] SEQ ID NO: 159
WP_019803776.1 type II CRISPR RNA-guided endonuclease Cas9 [*Streptococcus mutans*] SEQ ID NO: 160
WP_019805234.1 type II CRISPR RNA-guided endonuclease Cas9 [*Streptococcus mutans*] SEQ ID NO: 161
WP_024783594.1 type II CRISPR RNA-guided endonuclease Cas9 [*Streptococcus mutans*] SEQ ID NO: 162
WP_024784288.1 type II CRISPR RNA-guided endonuclease Cas9 [*Streptococcus mutans*] SEQ ID NO: 163
WP_024784666.1 type II CRISPR RNA-guided endonuclease Cas9 [*Streptococcus mutans*] SEQ ID NO: 164
WP_024784894.1 type II CRISPR RNA-guided endonuclease Cas9 [*Streptococcus mutans*] SEQ ID NO: 165
WP_024786433.1 type II CRISPR RNA-guided endonuclease Cas9 [*Streptococcus mutans*] SEQ ID NO: 166
WP_049473442.1 CRISPR-associated protein Csn1 [*Streptococcus mutans*] SEQ ID NO: 167
WP_049474547.1 CRISPR-associated protein Csn1 [*Streptococcus mutans*] SEQ ID NO: 168
EMC03581.1 hypothetical protein SMU69_09359 [*Streptococcus mutans NLML* 4] SEQ ID NO: 169
WP_000428612.1 type II CRISPR RNA-guided endonuclease Cas9 [*Streptococcus oralis*] SEQ ID NO: 170
WP_000428613.1 type II CRISPR RNA-guided endonuclease Cas9 [*Streptococcus oralis*] SEQ ID NO: 171
WP_049523028.1 CRISPR-associated protein Csn1 [*Streptococcus* parasanguinis] SEQ ID NO: 172
WP_003107102.1 type II CRISPR RNA-guided endonuclease Cas9 [*Streptococcus* parauberis] SEQ ID NO: 173
WP_054279288.1 type II CRISPR RNA-guided endonuclease Cas9 [*Streptococcus phocae*] SEQ ID NO: 174
WP_049531101.1 CRISPR-associated protein Csn1 [*Streptococcus* pseudopneumoniae] SEQ ID NO: 175
WP_049538452.1 CRISPR-associated protein Csn1 [*Streptococcus* pseudopneumoniae] SEQ ID NO: 176
WP_049549711.1 CRISPR-associated protein Csn1 [*Streptococcus* pseudopneumoniae] SEQ ID NO: 177
WP_007896501.1 type II CRISPR RNA-guided endonuclease Cas9 [*Streptococcus* pseudoporcinus] SEQ ID NO: 178
EFR44625.1 CRISPR-associated protein, Csn1 family [*Streptococcus* pseudoporcinus SPIN 20026] SEQ ID NO: 179
WP_002897477.1 type II CRISPR RNA-guided endonuclease Cas9 [*Streptococcus sanguinis*] SEQ ID NO: 180
WP_002906454.1 type II CRISPR RNA-guided endonuclease Cas9 [*Streptococcus sanguinis*] SEQ ID NO: 181
WP_009729476.1 type II CRISPR RNA-guided endonuclease Cas9 [*Streptococcus* sp. F0441] SEQ ID NO: 182
COR24647.1 CRISPR-associated protein [*Streptococcus* sp. FF10] SEQ ID NO: 183
WP_000066813.1 type II CRISPR RNA-guided endonuclease Cas9 [*Streptococcus* sp. M334] SEQ ID NO: 184
WP_009754323.1 type II CRISPR RNA-guided endonuclease Cas9 [*Streptococcus* sp. taxon 056] SEQ ID NO: 185
WP_044674937.1 type II CRISPR RNA-guided endonuclease Cas9 [*Streptococcus suis*] SEQ ID NO: 186
WP_044676715.1 type II CRISPR RNA-guided endonuclease Cas9 [*Streptococcus suis*] SEQ ID NO: 187
WP_044680361.1 type II CRISPR RNA-guided endonuclease Cas9 [*Streptococcus suis*] SEQ ID NO: 188
WP_044681799.1 type II CRISPR RNA-guided endonuclease Cas9 [*Streptococcus suis*] SEQ ID NO: 189
WP_049533112.1 CRISPR-associated protein Csn1 [*Streptococcus suis*] SEQ ID NO: 190
WP_029090905.1 type II CRISPR RNA-guided endonuclease Cas9 [*Brochothrix thermosphacta*] SEQ ID NO: 191
WP_006506696.1 type II CRISPR RNA-guided endonuclease Cas9 [*Catenibacterium mitsuokai*] SEQ ID NO: 192
AIT42264.1 Cas9hc: NLS:HA [Cloning vector pYB196] SEQ ID NO: 193
WP_034440723.1 type II CRISPR endonuclease Cas9 [Clostridiales bacterium S5-A11] SEQ ID NO: 194
AKQ21048.1 Cas9 [CRISPR-mediated gene targeting vector p (bhsp68-Cas9)] SEQ ID NO: 195
WP_004636532.1 type II CRISPR RNA-guided endonuclease Cas9 [Dolosigranulum pigrum] SEQ ID NO: 196
WP_002364836.1 MULTISPECIES: type II CRISPR RNA-guided endonuclease Cas9 [*Enterococcus*] SEQ ID NO: 197
WP_016631044.1 MULTISPECIES: type II CRISPR RNA-guided endonuclease Cas9 [*Enterococcus*] SEQ ID NO: 198

EMS75795.1 hypothetical protein H318_06676 [*Enterococcus durans* IPLA 655] SEQ ID NO: 199
WP_002373311.1 type II CRISPR RNA-guided endonuclease Cas9 [*Enterococcus faecalis*] SEQ ID NO: 200
WP_002378009.1 type II CRISPR RNA-guided endonuclease Cas9 [*Enterococcus faecalis*] SEQ ID NO: 201
WP_002407324.1 type II CRISPR RNA-guided endonuclease Cas9 [*Enterococcus faecalis*] SEQ ID NO: 202
WP_002413717.1 type II CRISPR RNA-guided endonuclease Cas9 [*Enterococcus faecalis*] SEQ ID NO: 203
WP_010775580.1 type II CRISPR RNA-guided endonuclease Cas9 [*Enterococcus faecalis*] SEQ ID NO: 204
WP_010818269.1 type II CRISPR RNA-guided endonuclease Cas9 [*Enterococcus faecalis*] SEQ ID NO: 205
WP_010824395.1 type II CRISPR RNA-guided endonuclease Cas9 [*Enterococcus faecalis*] SEQ ID NO: 206
WP_016622645.1 type II CRISPR RNA-guided endonuclease Cas9 [*Enterococcus faecalis*] SEQ ID NO: 207
WP_033624816.1 type II CRISPR RNA-guided endonuclease Cas9 [*Enterococcus faecalis*] SEQ ID NO: 208
WP_033625576.1 type II CRISPR RNA-guided endonuclease Cas9 [*Enterococcus faecalis*] SEQ ID NO: 209
WP_033789179.1 type II CRISPR RNA-guided endonuclease Cas9 [*Enterococcus faecalis*] SEQ ID NO: 210
WP_002310644.1 type II CRISPR RNA-guided endonuclease Cas9 [*Enterococcus faecium*] SEQ ID NO: 211
WP_002312694.1 type II CRISPR RNA-guided endonuclease Cas9 [*Enterococcus faecium*] SEQ ID NO: 212
WP_002314015.1 type II CRISPR RNA-guided endonuclease Cas9 [*Enterococcus faecium*] SEQ ID NO: 213
WP_002320716.1 type II CRISPR RNA-guided endonuclease Cas9 [*Enterococcus faecium*] SEQ ID NO: 214
WP_002330729.1 type II CRISPR RNA-guided endonuclease Cas9 [*Enterococcus faecium*] SEQ ID NO: 215
WP_002335161.1 type II CRISPR RNA-guided endonuclease Cas9 [*Enterococcus faecium*] SEQ ID NO: 216
WP_002345439.1 type II CRISPR RNA-guided endonuclease Cas9 [*Enterococcus faecium*] SEQ ID NO: 217
WP_034867970.1 type II CRISPR RNA-guided endonuclease Cas9 [*Enterococcus faecium*] SEQ ID NO: 218
WP_047937432.1 type II CRISPR RNA-guided endonuclease Cas9 [*Enterococcus faecium*] SEQ ID NO: 219
WP_010720994.1 type II CRISPR RNA-guided endonuclease Cas9 [*Enterococcus hirae*] SEQ ID NO: 220
WP_010737004.1 type II CRISPR RNA-guided endonuclease Cas9 [*Enterococcus hirae*] SEQ ID NO: 221
WP_034700478.1 type II CRISPR RNA-guided endonuclease Cas9 [*Enterococcus hirae*] SEQ ID NO: 222
WP_007209003.1 type II CRISPR RNA-guided endonuclease Cas9 [*Enterococcus italicus*] SEQ ID NO: 223
WP_023519017.1 type II CRISPR RNA-guided endonuclease Cas9 [*Enterococcus mundtii*] SEQ ID NO: 224
WP_010770040.1 type II CRISPR RNA-guided endonuclease Cas9 [*Enterococcus phoeniculicola*] SEQ ID NO: 225
WP_048604708.1 type II CRISPR RNA-guided endonuclease Cas9 [*Enterococcus sp. AM1*] SEQ ID NO: 226
WP_010750235.1 type II CRISPR RNA-guided endonuclease Cas9 [*Enterococcus villorum*] SEQ ID NO: 227
AII16583.1 Cas9 endonuclease [Expression vector pCas9] SEQ ID NO: 228
WP_029073316.1 type II CRISPR RNA-guided endonuclease Cas9 [*Kandleria vitulina*] SEQ ID NO: 229
WP_031589969.1 type II CRISPR RNA-guided endonuclease Cas9 [*Kandleria vitulina*] SEQ ID NO: 230
KDA45870.1 CRISPR-associated protein Cas9/Csn1, subtype II/NMEMI [*Lactobacillus animalis*] SEQ ID NO: 231
WP_039099354.1 type II CRISPR RNA-guided endonuclease Cas9 [*Lactobacillus curvatus*] SEQ ID NO: 232
AKP02966.1 hypothetical protein ABB45_04605 [*Lactobacillus* farciminis] SEQ ID NO: 233
WP_010991369.1 type II CRISPR RNA-guided endonuclease Cas9 [*Listeria innocua*] SEQ ID NO: 234
WP_033838504.1 type II CRISPR RNA-guided endonuclease Cas9 [*Listeria innocua*] SEQ ID NO: 235
EHN60060.1 CRISPR-associated protein, Csn1 family [*Listeria innocua* ATCC 33091] SEQ ID NO: 236
EFR89594.1 crispr-associated protein, Csn1 family [*Listeria innocua* FSL S4-378] SEQ ID NO: 237
WP_038409211.1 type II CRISPR RNA-guided endonuclease Cas9 [*Listeria ivanovii*] SEQ ID NO: 238
EFR95520.1 crispr-associated protein Csn1 [*Listeria ivanovii* FSL F6 596] SEQ ID NO: 239
WP_003723650.1 type II CRISPR RNA-guided endonuclease Cas9 [*Listeria monocytogenes*] SEQ ID NO: 240
WP_003727705.1 type II CRISPR RNA-guided endonuclease Cas9 [*Listeria monocytogenes*] SEQ ID NO: 241
WP_003730785.1 type II CRISPR RNA-guided endonuclease Cas9 [*Listeria monocytogenes*] SEQ ID NO: 242
WP_003733029.1 type II CRISPR RNA-guided endonuclease Cas9 [*Listeria monocytogenes*] SEQ ID NO: 243
WP_003739838.1 type II CRISPR RNA-guided endonuclease Cas9 [*Listeria monocytogenes*] SEQ ID NO: 244
WP_014601172.1 type II CRISPR RNA-guided endonuclease Cas9 [*Listeria monocytogenes*] SEQ ID NO: 245
WP_023548323.1 type II CRISPR RNA-guided endonuclease Cas9 [*Listeria monocytogenes*] SEQ ID NO: 246
WP_031665337.1 type II CRISPR RNA-guided endonuclease Cas9 [*Listeria monocytogenes*] SEQ ID NO: 247
WP_031669209.1 type II CRISPR RNA-guided endonuclease Cas9 [*Listeria monocytogenes*] SEQ ID NO: 248
WP_033920898.1 type II CRISPR RNA-guided endonuclease Cas9 [*Listeria monocytogenes*] SEQ ID NO: 249
AKI42028.1 CRISPR-associated protein [*Listeria monocytogenes*] SEQ ID NO: 250
AKI50529.1 CRISPR-associated protein [*Listeria monocytogenes*] SEQ ID NO: 251
EFR83390.1 crispr-associated protein Csn1 [*Listeria monocytogenes* FSL F2-208] SEQ ID NO: 252
WP_046323366.1 type II CRISPR RNA-guided endonuclease Cas9 [*Listeria seeligeri*] SEQ ID NO: 253
AKE81011.1 Cas9 [Plant multiplex genome editing vector PYLCRISPR/Cas9Pubi-H] SEQ ID NO: 254
CUO82355.1 Uncharacterized protein conserved in bacteria [*Roseburia hominis*] SEQ ID NO: 255
WP_033162887.1 type II CRISPR RNA-guided endonuclease Cas9 [Sharpea azabuensis] SEQ ID NO: 256
AGZ01981.1 Cas9 endonuclease [synthetic construct] SEQ ID NO: 257
AKA60242.1 nuclease deficient Cas9 [synthetic construct] SEQ ID NO: 258
AKS40380.1 Cas9 [Synthetic plasmid pFC330] SEQ ID NO: 259
4UN5_B Cas9, Chain B, Crystal Structure SEQ ID NO: 260

Example 2: Exemplary Adenosine Deaminases and Recombinant ecTadA Domains

Some aspects of this disclosure relate to the use of adenosine deaminase domains, such as, for example, in a fusion protein comprising a napDNAbp and a nucleic acid editing domain, wherein the nucleic acid editing domain is an adenosine deaminase. In some embodiments, the adenosine deaminase comprises an amino acid sequence that is at least 60%, 65%, 70%, 75%, 80%, 85%, 90%, 95, 98%, 99%, or 99.5% identical to any one of SEQ ID NOs: 400-458, or any of the adenosine deaminases provided herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth in SEQ ID NOs: 400-458, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 166, identical contiguous amino acid residues as compared to any one of the amino acid sequences set forth in SEQ ID NOs: 400-458, or any of the adenosine deaminases provided herein. In some embodiments, the adenosine deaminase comprises the amino acid sequence of any one of SEQ ID NOs: 400-458, or any of the adenosine deaminases provided herein. In some embodiments, the adenosine deaminase consists of the amino acid sequence of any one of SEQ ID NOs: 400-458, or any of the adenosine deaminases provided herein. The ecTadA sequences provided below are from ecTadA (SEQ ID NO: 400), absent the N-terminal methionine (M). The saTadA sequences provided below are from saTadA (SEQ ID NO: 402), absent the N-terminal methionine (M). For clarity, the amino acid numbering scheme used to identify the various amino acid mutations is derived from ecTadA (SEQ ID NO: 400) for *E. coli* TadA and saTadA (SEQ ID NO: 402) for *S. aureus* TadA. Amino acid mutations, relative to SEQ ID NO: 400 (ecTadA) or SEQ DI NO: 402 (saTadA), are indicated by underlining.

```
ecTadA
                                                          (SEQ ID NO: 409)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMRRQEIKAQKKAQSSTD ecTadA (D108N)
                                                          (SEQ ID NO: 410)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARNAKTGAAGSLMDVLHHPGMNHRVEITEGILAD
ECAALLSDFFRMRRQEIKAQKKAQSSTD ecTadA (D108G)
                                                          (SEQ ID NO: 411)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARGAKTGAAGSLMDVLHHPGMNHRVEITEGILAD
ECAALLSDFFRMRRQEIKAQKKAQSSTD ecTadA (D108V)
                                                          (SEQ ID NO: 412)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARVAKTGAAGSLMDVLHHPGMNHRVEITEGILAD
ECAALLSDFFRMRRQEIKAQKKAQSSTD ecTadA (H8Y, D108N, and N127S)
                                                          (SEQ ID NO: 413)
SEVEFSYEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARNAKTGAAGSLMDVLHHPGMSHRVEITEGILAD
ECAALLSDFFRMRRQEIKAQKKAQSSTD ecTadA (H8Y, D108N, N127S, and E155D)
                                                          (SEQ ID NO: 414)
SEVEFSYEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARNAKTGAAGSLMDVLHHPGMSHRVEITEGILAD
ECAALLSDFFRMRRQDIKAQKKAQSSTD ecTadA (H8Y, D108N, N127S, and E155G)
                                                          (SEQ ID NO: 415)
SEVEFSYEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARNAKTGAAGSLMDVLHHPGMSHRVEITEGILAD
ECAALLSDFFRMRRQGIKAQKKAQSSTD ecTadA (H8Y, D108N, N127S, and E155V)
                                                          (SEQ ID NO: 416)
SEVEFSYEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARNAKTGAAGSLMDVLHHPGMSHRVEITEGILAD
ECAALLSDFFRMRRQVIKAQKKAQSSTD ecTadA (A106V, D108N, D147Y, and E155V)
                                                          (SEQ ID NO: 417)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGVRNAKTGAAGSLMDVLHHPGMNHRVEITEGILAD
ECAALLSYFFRMRRQVIKAQKKAQSSTD
```

-continued ecTadA (L84F, A106V, D108N, H123Y, D147Y, E155V, I156F)
(SEQ ID NO: 418)
SEVEFSHEYWMRHALTLAKRAWDEREVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSID ecTadA (S2A, I49F, A106V, D108N, D147Y, E155V)
(SEQ ID NO: 419)
AEVEFSHEYWMRHALTLAKRAWDEREVPVGAVLVHNNRVIGEGWNRPFGRHDPTAHAEIMALRQGGLVM
QNYRLIDATLYVTLEPCVMCAGAMIHSRIGRVVFGVRNAKTGAAGSLMDVLHHPGMNHRVEITEGILAD
ECAALLSYFFRMRRQVIKAQKKAQSSTD ecTadA (H8Y, A106T, D108N, N127S, K160S)
(SEQ ID NO: 420)
SEVEFSYEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGTRNAKTGAAGSLMDVLHHPGMSHRVEITEGILAD
ECAALLSDFFRMRRQEIKAQSKAQSSTD ecTadA (R26G, L84F, A106V, R107H, D108N, H123Y, A142N, A143D, D147Y,
E155V, I156F)
(SEQ ID NO: 421)
SEVEFSHEYWMRHALTLAKRAWDEGEVPVGAVLVHNNRVIGEGWNRPIGRHDPTAHAEIMALRQGGLVM
QNYRLIDATLYVTFEPCVMCAGAMIHSRIGRVVFGVHNAKTGAAGSLMDVLHYPGMNHRVEITEGILAD
ECNDLLSYFFRMRRQVFKAQKKAQSSID ecTadA (E25G, R26G, L84F, A106V, R107H, D108N, H123Y, A142N, A143D,
D147Y, E155V, I156F)
(SEQ ID NO: 422)
SEVEFSHEYWMRHALTLAKRAWDGGEVPVGAVLVHNNRVIGEGWNRPIGRHDPTAHAEIMALRQGGLVM
QNYRLIDATLYVTFEPCVMCAGAMIHSRIGRVVFGVHNAKTGAAGSLMDVLHYPGMNHRVEITEGILAD
ECNDLLSYFFRMRRQVFKAQKKAQSSID ecTadA (E25D, R26G, L84F, A106V, R107K, D108N, H123Y, A142N, A143G,
D147Y, E155V, I156F)
(SEQ ID NO: 423)
SEVEFSHEYWMRHALTLAKRAWDDGEVPVGAVLVHNNRVIGEGWNRPIGRHDPTAHAEIMALRQGGLVM
QNYRLIDATLYVTFEPCVMCAGAMIHSRIGRVVFGVKNAKTGAAGSLMDVLHYPGMNHRVEITEGILAD
ECNGLLSYFFRMRRQVFKAQKKAQSSID ecTadA (R26Q, L84F, A106V, D108N, H123Y, A142N, D147Y, E155V, I156F)
(SEQ ID NO: 424)
SEVEFSHEYWMRHALTLAKRAWDEQEVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECNALLSYFFRMRRQVFKAQKKAQSSID ecTadA (E25M, R26G, L84F, A106V, R107P, D108N, H123Y, A142N, A143D,
D147Y, E155V, I156F)
(SEQ ID NO: 425)
SEVEFSHEYWMRHALTLAKRAWDMGEVPVGAVLVHNNRVIGEGWNRPIGRHDPTAHAEIMALRQGGLVM
QNYRLIDATLYVTFEPCVMCAGAMIHSRIGRVVFGVPNAKTGAAGSLMDVLHYPGMNHRVEITEGILAD
ECNDLLSYFFRMRRQVFKAQKKAQSSID ecTadA (R26C, L84F, A106V, R107H, D108N, H123Y, A142N, D147Y, E155V,
I156F)
(SEQ ID NO: 426)
SEVEFSHEYWMRHALTLAKRAWDECEVPVGAVLVHNNRVIGEGWNRPIGRHDPTAHAEIMALRQGGLVM
QNYRLIDATLYVTFEPCVMCAGAMIHSRIGRVVFGVHNAKTGAAGSLMDVLHYPGMNHRVEITEGILAD
ECNALLSYFFRMRRQVFKAQKKAQSSID ecTadA (L84F, A106V , D108N, H123Y, A142N, A143L, D147Y, E155V, I156F)
(SEQ ID NO: 427)
SEVEFSHEYWMRHALTLAKRAWDEREVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECNLLLSYFFRMRRQVFKAQKKAQSSTD ecTadA (R26G, L84F, A106V, D108N, H123Y, A142N, D147Y, E155V, I156F)
(SEQ ID NO: 428)
SEVEFSHEYWMRHALTLAKRAWDEGEVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECNALLSYFFRMRRQVFKAQKKAQSSID ecTadA (E25A, R26G, L84F, A106V, R107N, D108N, H123Y, A142N, A143E,
D147Y, E155V, I156F)
(SEQ ID NO: 429)
SEVEFSHEYWMRHALTLAKRAWDAGEVPVGAVLVHNNRVIGEGWNRPIGRHDPTAHAEIMALRQGGLVM
QNYRLIDATLYVTFEPCVMCAGAMIHSRIGRVVEGVNNAKTGAAGSLMDVLHYPGMNHRVEITEGILAD
ECNELLSYFFRMRRQVFKAQKKAQSSID -continued ecTadA (L84F, A106V, D108N, H123Y, D147Y, E155V, I156F)
(SEQ ID NO: 430)
SEVEFSHEYWMRHALTLAKRAWDEREVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSTD ecTadA (N37T, P48T, L84F, A106V, D108N, H123Y, D147Y, E155V, I156F)
(SEQ ID NO: 431)
SEVEFSHEYWMRHALTLAKRAWDEREVPVGAVLVHTNRVIGEGWNRTIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSTD ecTadA (N37S, L84F, A106V, D108N, H123Y, D147Y, E155V, I156F)
(SEQ ID NO: 432)
SEVEFSHEYWMRHALTLAKRAWDEREVPVGAVLVHSNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSTD ecTadA (H36L, L84F, A106V, D108N, H123Y, D147Y, E155V, I156F)
(SEQ ID NO: 433)
SEVEFSHEYWMRHALTLAKRAWDEREVPVGAVLVLNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSTD ecTadA (L84F, A106V, D108N, H123Y, S146R, D147Y, E155V, I156F)
(SEQ ID NO: 434)
SEVEFSHEYWMRHALTLAKRAWDEREVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLRYFFRMRRQVFKAQKKAQSSTD ecTadA (H36L, P48L, L84F, A106V, D108N, H123Y, D147Y, E155V, I156F)
(SEQ ID NO: 435)
SEVEFSHEYWMRHALTLAKRAWDEREVPVGAVLVLNNRVIGEGWNRLIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSTD ecTadA (H36L, L84F, A106V, D108N, H123Y, D147Y, E155V, K57N, I156F)
(SEQ ID NO: 436)
SEVEFSHEYWMRHALTLAKRAWDEREVPVGAVLVLNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFNAQKKAQSSTD ecTadA (H36L, L84F, A106V, D108N, H123Y, S146C, D147Y, E155V, I156F)
(SEQ ID NO: 437)
SEVEFSHEYWMRHALTLAKRAWDEREVPVGAVLVLNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLCYFFRMRRQVFKAQKKAQSSID ecTadA (L84F, A106V, D108N, H123Y, S146R, D147Y, E155V, I156F)
(SEQ ID NO: 438)
SEVEFSHEYWMRHALTLAKRAWDEREVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLRYFFRMRRQVFKAQKKAQSSTD ecTadA (N37S, R51H, L84F, A106V, D108N, H123Y, D147Y, E155V, I156F)
(SEQ ID NO: 439)
SEVEFSHEYWMRHALTLAKRAWDEREVPVGAVLVHSNRVIGEGWNRPIGHHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSID ecTadA (R51L, L84F, A106V, D108N, H123Y, D147Y, E155V, I156F, K157N)
(SEQ ID NO: 440)
SEVEFSHEYWMRHALTLAKRAWDEREVPVGAVLVHNNRVIGEGWNRPIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFNAQKKAQSSTD ecTadA (R51H, L84F, A106V, D108N, H123Y, D147Y, E155V, I156F, K157N)
(SEQ ID NO: 441)
SEVEFSHEYWMRHALTLAKRAWDEREVPVGAVLVHNNRVIGEGWNRPIGHHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFNAQKKAQSSID ecTadA (P48S)
(SEQ ID NO: 442)
SEVEFSHEYWMRHALTLAKRAWDEREVPVGAVLVHNNRVIGEGWNRSIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMRRQEIKAQKKAQSSTD -continued ecTadA (P48T)

(SEQ ID NO: 443)
SEVEFSHEYWMRHALTLAKRAWDEREVPVGAVLVHNNRVIGEGWNRTIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMRRQEIKAQKKAQSSTD ecTadA (P48A)

(SEQ ID NO: 444)
SEVEFSHEYWMRHALTLAKRAWDEREVPVGAVLVHNNRVIGEGWNRAIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMRRQEIKAQKKAQSSTD ecTadA (A142N)

(SEQ ID NO: 445)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECNALLSDFFRMRRQEIKAQKKAQSSTD ecTadA (W23R)

(SEQ ID NO: 446)
SEVEFSHEYWMRHALTLAKRARDEREVPVGAVLVHNNRVIGEGWNRPIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMRRQEIKAQKKAQSSTD ecTadA (W23L)

(SEQ ID NO: 447)
SEVEFSHEYWMRHALTLAKRALDEREVPVGAVLVHNNRVIGEGWNRPIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMRRQEIKAQKKAQSSTD ecTadA (R152P)

(SEQ ID NO: 448)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMPRQEIKAQKKAQSSTD ecTadA (R152H)

(SEQ ID NO: 449)
SEVEFSHEYWMRHALTLAKRAWDEREVPVGAVLVHNNRVIGEGWNRPIGRHDPTAHAEIMALRQGGLVM
QNYRLIDATLYVTLEPCVMCAGAMIHSRIGRVVFGARDAKTGAAGSLMDVLHHPGMNHRVEITEGILAD
ECAALLSDFFRMHRQEIKAQKKAQSSTD ecTadA (L84F, A106V, D108N, H123Y, D147Y, E155V, I156F)

(SEQ ID NO: 450)
SEVEFSHEYWMRHALTLAKRAWDEREVPVGAVLVHNNRVIGEGWNRPIGRHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLSYFFRMRRQVFKAQKKAQSSID ecTadA (H36L, R51L, L84F, A106V, D108N, H123Y, S146C, D147Y, E155V, I156F, K157N)

(SEQ ID NO: 451)
SEVEFSHEYWMRHALTLAKRAWDEREVPVGAVLVLNNRVIGEGWNRPIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLCYFFRMRRQVFNAQKKAQSSTD ecTadA (H36L, P48S, R51L, L84F, A106V, D108N, H123Y, S146C, D147Y, E155V, I156F, K157N)

(SEQ ID NO: 452)
SEVEFSHEYWMRHALTLAKRAWDEREVPVGAVLVLNNRVIGEGWNRSIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLCYFFRMRRQVFNAQKKAQSSTD ecTadA (H36L, P48A, R51L, L84F, A106V, D108N, H123Y, S146C, D147Y, E155V, I156F, K157N)

(SEQ ID NO: 453)
SEVEFSHEYWMRHALTLAKRAWDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLCYFFRMRRQVFNAQKKAQSSTD ecTadA
(W23L, H36L, P48A, R51L, L84F, A106V, D108N, H123Y, S146C, D147Y, R152P, E155V, I156F, K157N)

(SEQ ID NO: 454)
SEVEFSHEYWMRHALTLAKRALDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLCYFFRMPRQVFNAQKKAQSSTD

-continued ecTadA (H36L, P48S, R51L, L84F, A106V, D108N, H123Y, A142N, S146C,
D147Y, E155V, I156F, K157N)

(SEQ ID NO: 455)
SEVEFSHEYWMRHALTLAKRAWDEREVPVGAVLVLNNRVIGEGWNRSIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECNALLCYFFRMRRQVFNAQKKAQSSID ecTadA (WDL, H36L, P48A, R51L, L84F, A106V, D108N, H123Y, A142N, S146C,
D147Y, E155V, I156F, K157N)

(SEQ ID NO: 456)
SEVEFSHEYWMRHALTLAKRALDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECNALLCYFFRMRRQVFNAQKKAQSSID ecTadA
(W23L, H36L, P48A, R51L, L84F, A106V, D108N, H123Y, A142N, S146C,
D147Y, R152P, E155V, I156F, K157N)

(SEQ ID NO: 457)
SEVEFSHEYWMRHALTLAKRALDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECNALLCYFFRMPRQVFNAQKKAQSSTD ecTadA (W23R, H36L, P48A, R51L, L84F, A106V, D108N, H123Y, S146C,
D147Y, R152P, E155V, I156F, K157N)

(SEQ ID NO: 458)
SEVEFSHEYWMRHALTLAKRALDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHYPGMNHRVEITEGILAD
ECAALLCYFFRMPRQVFNAQKKAQSSID

Example 4: Rewritable Multi-Event Analog Recording in Bacterial and Mammalian Cells Mediated by Base Editors and CRISPR Nucleases The stable recording of cellular events has the potential to advance the understanding of a cell's history and its responses to stimuli. The construction of intracellular memory devices that record a history of cellular events, however, has proven very challenging. Two CRISPR-mediated analog multi-event recording apparatus (CAMERA) systems are presented herein that use base editors and Cas9 nucleases to stably record molecular events of interest in the DNA content of living cells. The devices record the amplitude and duration of exogenous signals in an analog mode as changes in the ratio of mutually exclusive genomic or extrachromosomal DNA sequences and offer a large storage capacity while consuming limited cellular resources. Simultaneous recording of multiple stimuli including exposure to antibiotics, nutrients, viruses, light, and a kinase inhibitor was achieved by integrating diverse synthetic circuits into CAMERA 1 and CAMERA 2. The order of stimuli can be recorded through an overlapping guide RNA design. When recording to multi-copy plasmids, the device functions at the single-cell level and a reliable readout can be obtained by sequencing as few as 10-100 cells. Recorded memories can be erased and re-recorded over multiple cycles. The CAMERA 2 system was used in human cells to record the presence of exogenous small molecules as well as changes in Wnt signaling as single-base changes at a safe-harbor locus in the human genome. CAMERA systems can serve as "cell data recorders" that write a history of endogenous or exogenous signals into permanent DNA sequence modifications in living cells.

Recent technologies have enabled the study of the internal state of cells in exquisite detail, including the sequence of the genome, the status of epigenetic modifications, and the identity and abundance of cellular RNAs, proteins, metabolites that collectively determine cell state (1, 2). Far less developed are tools to reveal a cell's history and how that history determines present and future cell states, despite the potential impact of such capabilities. Detailed information on cell states during division and differentiation, for example, could illuminate the process of aging, and recording the presence and duration of exposure to external or internal stresses could inform the emergence of cancer and other diseases. Recording a cell's history in a highly multiplexable, durable, and minimally perturbative form has been a long-standing challenge of the life sciences (3, 4).

Transient recording of environmental signals has been achieved by manipulating transcription and translation in bacteria (5). Information recorded in this manner, however, cannot be passed on to future generations of cells and the recording process itself is delicate since many factors contribute to transcription and translation efficiencies. In contrast, recombinases can activate bi-stable toggle switches embedded in the genome and the resulting information stored in DNA can be read even after cell death (6, 7). Although individual signals of interest can be stably recorded using recombinase-based memory devices, orthogonal recombinases are required to record more than one bit of information. Moreover, bi-stable toggle switches operated by recombinases can record the presence or suggest the absence of the stimuli of interest, but their use to record signal strength, duration, or order is challenging (3).

In contrast to digital memory devices that store information in one of two distinct states (on or off), synthetic analog memory devices that leave permanent marks in DNA in a manner that reflects the strength or duration of endogenous or exogenous stimuli in theory could illuminate cellular history, reveal how a stimulus dictates downstream responses, and improve our ability to predict cell behavior (3). Recently Lu and coworkers reported synthetic cellular recorders integrating biological events (SCRIBE), an elegant memory device that translates exogenous signals into point mutations in a bacterial genome through Beta protein-assisted single-stranded DNA incorporation (8). Because the production of single-stranded DNA by the adapted retrovirus cassette is not efficient, SCRIBE requires the sampling of large populations of bacteria for both recording and readout (8).

To develop a memory device that is less dependent on a large cell population, we chose the clustered regularly interspaced short palindromic repeats (CRISPR)-Cas9 nuclease (9-11) and CRISPR-derived base editors (12, 13) to serve as DNA writing modules. Both Cas9 nuclease and base editors make changes in cellular DNA in an efficient and programmable manner when complexed with guide RNAs (9, 12). If linked to stimuli or cell state changes, these DNA modifications in principle could serve as durable messages that reflect a cell's history and could be read out using modern sequencing technologies, even after cell death. In this work, we present two CRISPR-mediated analog multi-event recording apparatus (CAMERA) systems and demonstrate their ability to record simultaneously multiple cell states, including exposure to antibiotics, nutrients, viruses, light, and a kinase inhibitor that alters endogenous Wnt signaling. CAMERA systems record both the strength of signals and the duration of exposure as durable and predictable changes in the DNA of bacteria or mammalian cells.

A Plasmid Compensation System as an Information Carrier in Bacteria

The S. pyogenes Cas9 (SpCas9) nuclease was chosen as an initial DNA writing module because it functions robustly across many different cell types in vitro and in vivo (11, 14). SpCas9 makes double-stranded DNA breaks at loci that match the 20-base "spacer region" of a single guide RNA (sgRNA) and that are near an NGG protospacer-adjacent motif (PAM). In mammalian cells, the resulting double-stranded breaks can be repaired by nonhomologous end joining (NHEJ) and similar processes to introduce insertions and deletions (indels), or through homology-directed repair (HDR) by supplying a template strand. In bacteria, however, double-stranded DNA breaks frequently cause cell death or a loss of extrachromosomal DNA (15, 16). To translate DNA loss following double-stranded breaks into durable information, a high-copy number plasmid compensation system to store DNA modification states was designed. This strategy enables analog recording within each cell and thereby avoids dependence on large cell populations.

The plasmid compensation system includes a pair of nearly identical recording plasmids, R1 and R2, that differ only at a 3-nucleotide coding mutation in an EGFP gene (FIG. 1A). The EGFP gene encoded by R1 expresses full length-fluorescent protein, whereas the EGFP gene in R2 contains a premature stop codon and cannot produce fluorescent protein (FIG. 1A). Because the two plasmids are virtually identical, it was hypothesized that their fitness cost to host cells is very similar and they should coexist in a stable ratio for long periods of time.

The R1:R2 ratio serves as the information carrier that reflects the signal of interest in an analog mode. To convert the signal of interest into an R1:R2 ratio change, a Cas9:sgRNA pair induced by the stimulus cleaves plasmid R1 but not R2 (FIG. 1A). The resulting double-stranded break causes the loss of R1. Because the two recording plasmids share the same origin of replication that controls the total copy number of the plasmids in bacteria, the loss of R1 initiates the replication of the remaining plasmids and the gradual accumulation of R2. A high copy number plasmid (pUC) was chosen to maximize the analog recording range of the system (FIG. 1A).

Figure 1B:
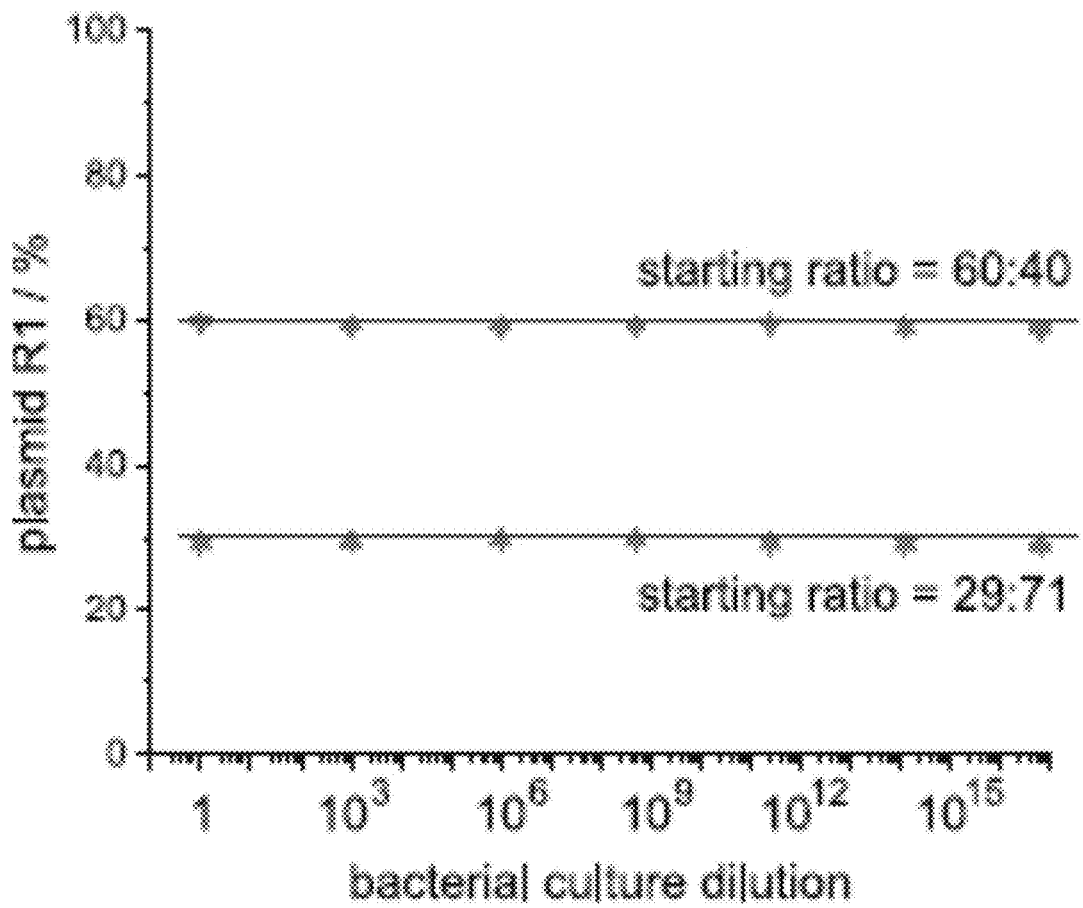

To test the stability of the plasmid compensation recording system, E. coli strain S1030 (17) was co-transformed with R1 and R2 and two single colonies with different R1:R2 ratios were isolated. The colonies were separately grown in LB media at 37° C. and the culture was diluted 500- or 1,000-fold six times over 144 hours for a total dilution ratio of 1017 (FIG. 1B). The two starting colonies contained 29% R1 and 60% R1, and their R1:R2 ratio was very stably maintained throughout the growth and dilution process (FIG. 1B), ending at 29% R1 and 59% R1, respectively. These results indicate that R1:R2 ratio can serve as a stable analog information carrier across a range of plasmid ratios.

Figure 6:
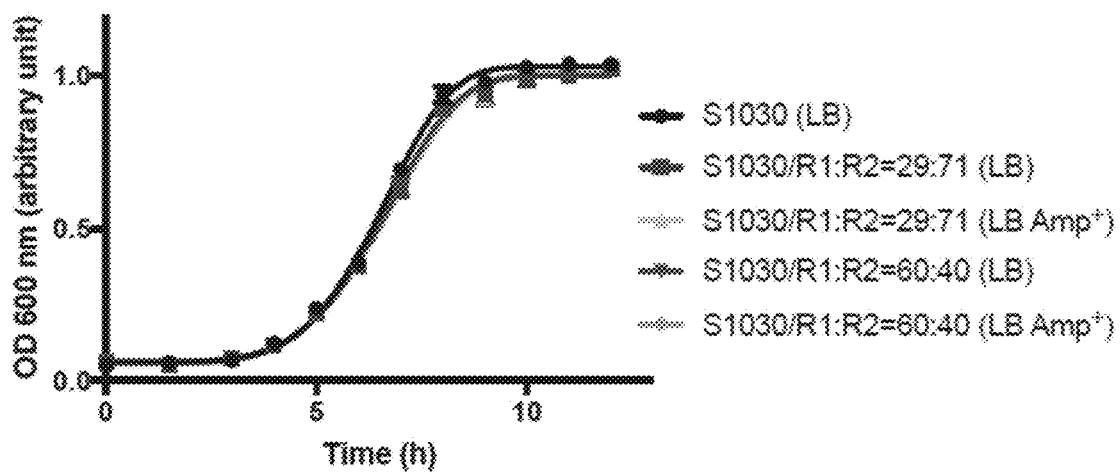
FIG. 6 depicts growth curves of wild-type E. coli S1030 and E. coli S1030 transformed with a recording plasmid pair of different starting ratios in the presence or absence of the selection antibiotic. Three individual cultures were grown in a 24-deep-well plate at 37° C. with shaking for each tested condition. A 200-µL aliquot was transferred to a 96-well clear-bottom assay plate at the designed time points and the absorbance at 600 nm was measure using a TECAN Infinite M1000 Pro plate reader.

To assess the potential growth burden that the recording plasmid pair might impose on bacteria, growth curves were measured for the parental E. coli strain S1030 and two S1030 colonies containing R1 and R2 in different ratios (29% R1 or 60% R1, FIG. 6). The colonies harboring R1 and R2 exhibited the same growth rate as the parental strain in the presence or absence of the selection antibiotic and all bacterial cultures reached the same final cell density, suggesting that the recording plasmids do not substantially impair bacterial fitness.

A CRISPR Nuclease Writing Module Enables CAMERA 1

Figure 1C:
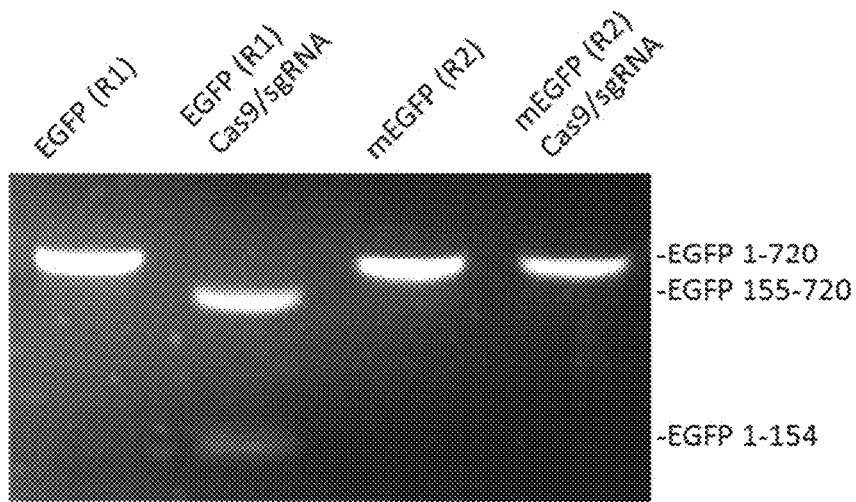

A writing module was designed that cleaves R1 but not R2 at the three-nucleotide region that differs between R1 and R2. This region was chosen to be proximal to the PAM to maximize the selectivity of the writing module (18) (FIG. 1A). The EGFP gene fragments from both plasmids were incubated in vitro with the Cas9:sgRNA complex. The functional EGFP gene amplified from plasmid R1, but not the mutated EGFP gene encoded by plasmid R2, was cleaved into two fragments (FIG. 1C). These results establish that the writing module can distinguish plasmids R1 and R2 and introduce double-stranded breaks selectively in R1.

Figure 1D:
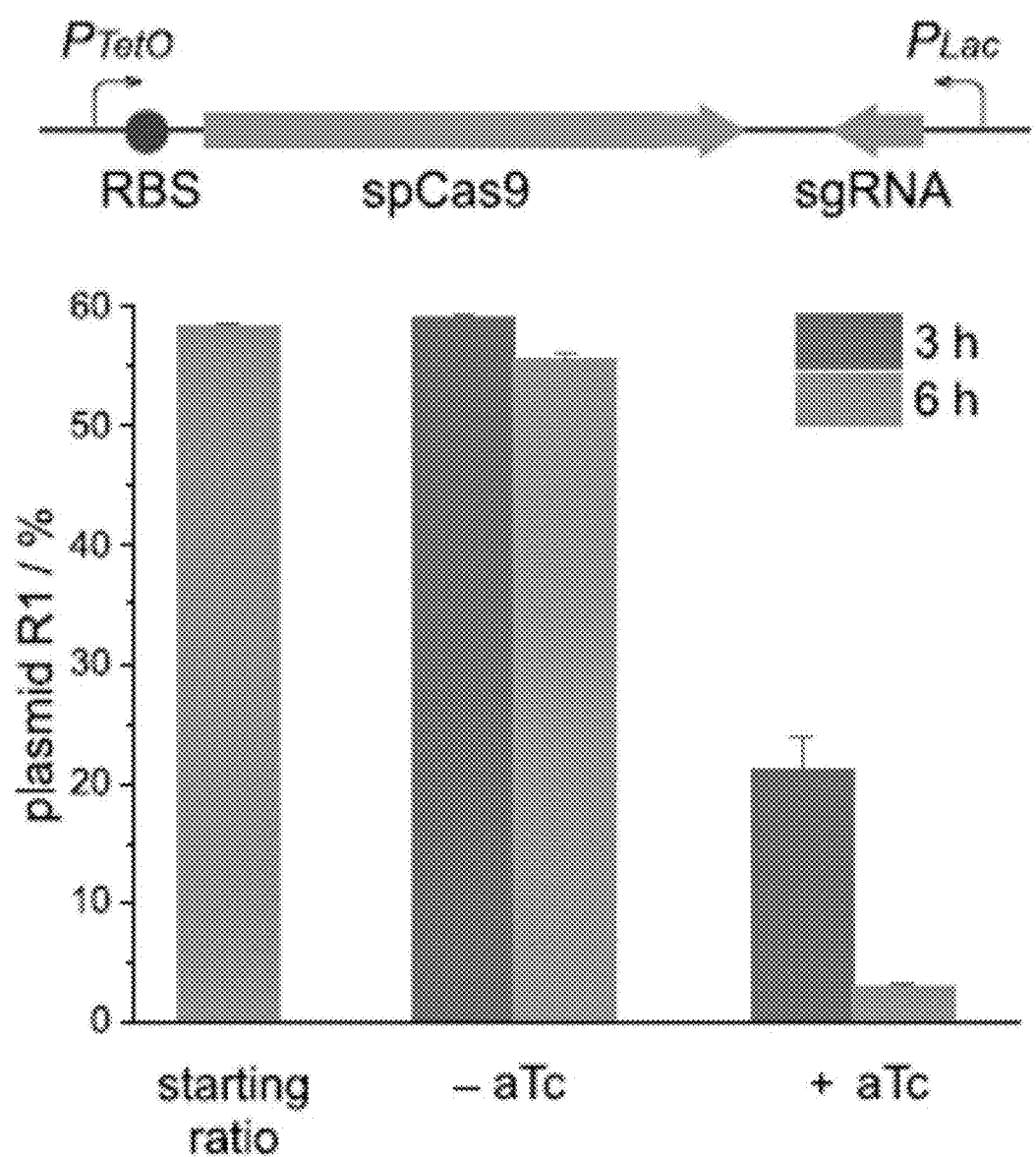
Figure 7:
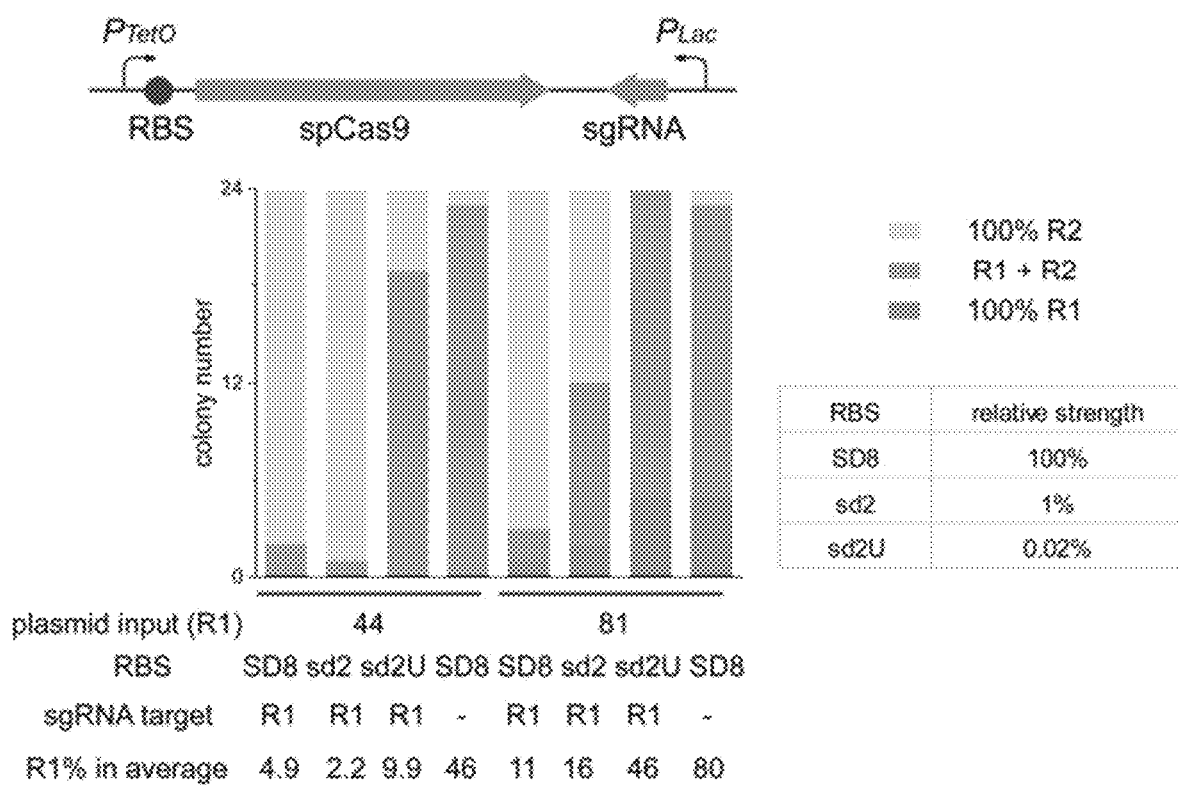
FIG. 7 depicts tuning the sensitivities of the writing plasmid by varying the Cas9 RBS. A weaker RBS (sd2U) and higher starting R1 content for transformation facilitate harvesting bacteria carrying both recording plasmids.

Next the system was moved into live bacteria to test if it could translate an exogenous signal into a durable change in the DNA content of the cell. A TetO promoter that is inducible with anhydrotetracycline (aTc) was placed upstream of the Cas9 gene, and placed a constitutive Lac promoter upstream of the R1-targeting sgRNA in writing plasmids W1.0.1-W1.0.3 (FIG. 1D and FIG. 7), forming the CAMERA 1.0 system. Bacteria containing CAMERA 1.0 with a R1:R2 ratio of 58:42 were used to test aTc-stimulated recording. After being cultured in the presence or absence of aTc for 3 hours and 6 hours, the bacteria were harvested and analyzed for their R1 content by high-throughput sequencing (HTS). In the absence of aTc, R1 content remained steady (59%) after 3 hours and was only slightly lower (56%) after 6 hours (FIG. 1D). This basal level of R1 consumption can be attributed to low-level transcription of the uninduced TetO promoter. In contrast, R1 content responded strongly to the presence of aTc and decreased to 21% in 3 hours, and to 4% after 6 hours (FIG. 1D). Collectively, these results suggest that CAMERA 1.0 can sensitively detect and record the presence of an exogenous small molecule and the duration of exposure in an analog format.

Recording of Multiple Stimuli Using CAMERA 1 Derivatives

Figure 2A:
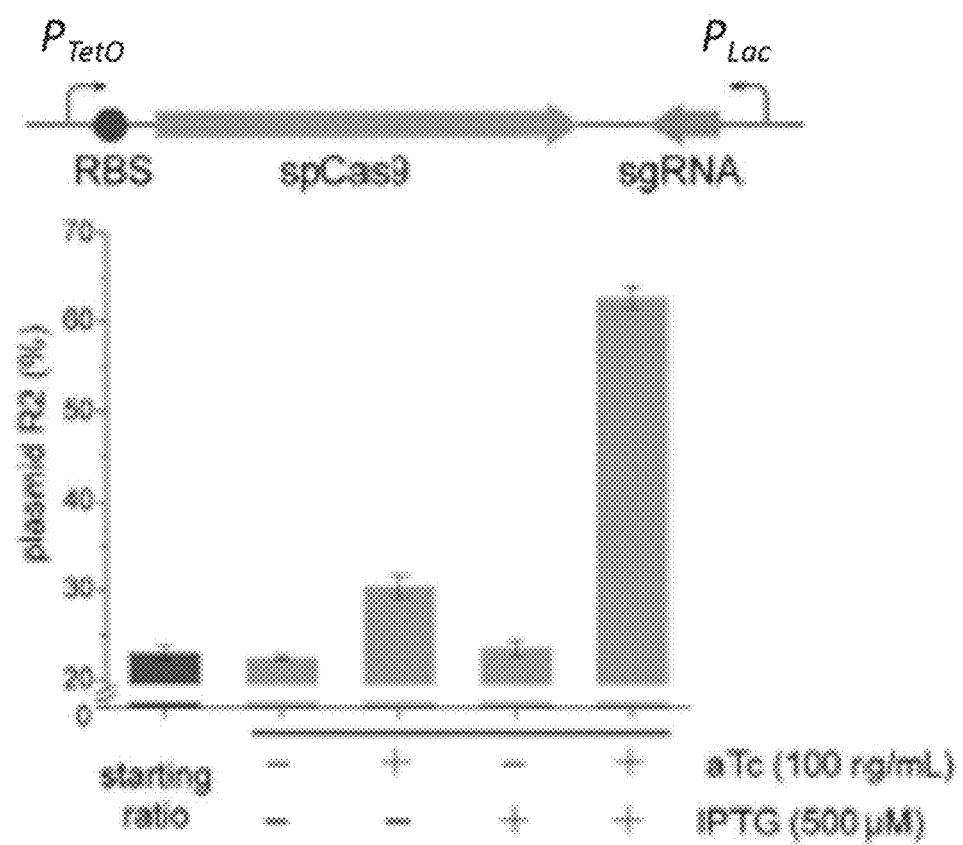
FIGS. 2A-2E depict the multi-event recording and resetting of CAMERA 1 systems.

To enable recording of more than one stimulus, the LacO promoter was installed, which was suppressed by LacI and activated by IPTG, upstream of the sgRNA to generate CAMERA 1.1 (FIG. 2A). Both aTc and IPTG are required to initiate recording in CAMERA 1.1. A bacterial colony carrying CAMERA 1.1 with a starting R1 content of 77% was chosen and applied different inducer combinations for 3 hours (FIG. 2A). As expected, R1:R2 ratio remained stable in the absence of stimuli or in the presence of 0.5 mM IPTG only. A slightly lower R1 content (to 70%) was observed when the bacteria were treated with 100 ng/ml aTc only (FIG. 2A), consistent with the known leakiness of the LacO promoter in the absence of IPTG (19). Importantly, R1 content decreased to 37% when bacteria were cultured in the presence of both aTc and IPTG (FIG. 2A), indicating that both stimuli are required to promote substantial R1:R2 ratio changes, recapitulating an "AND" Boolean logic gate.

Figure 2B:
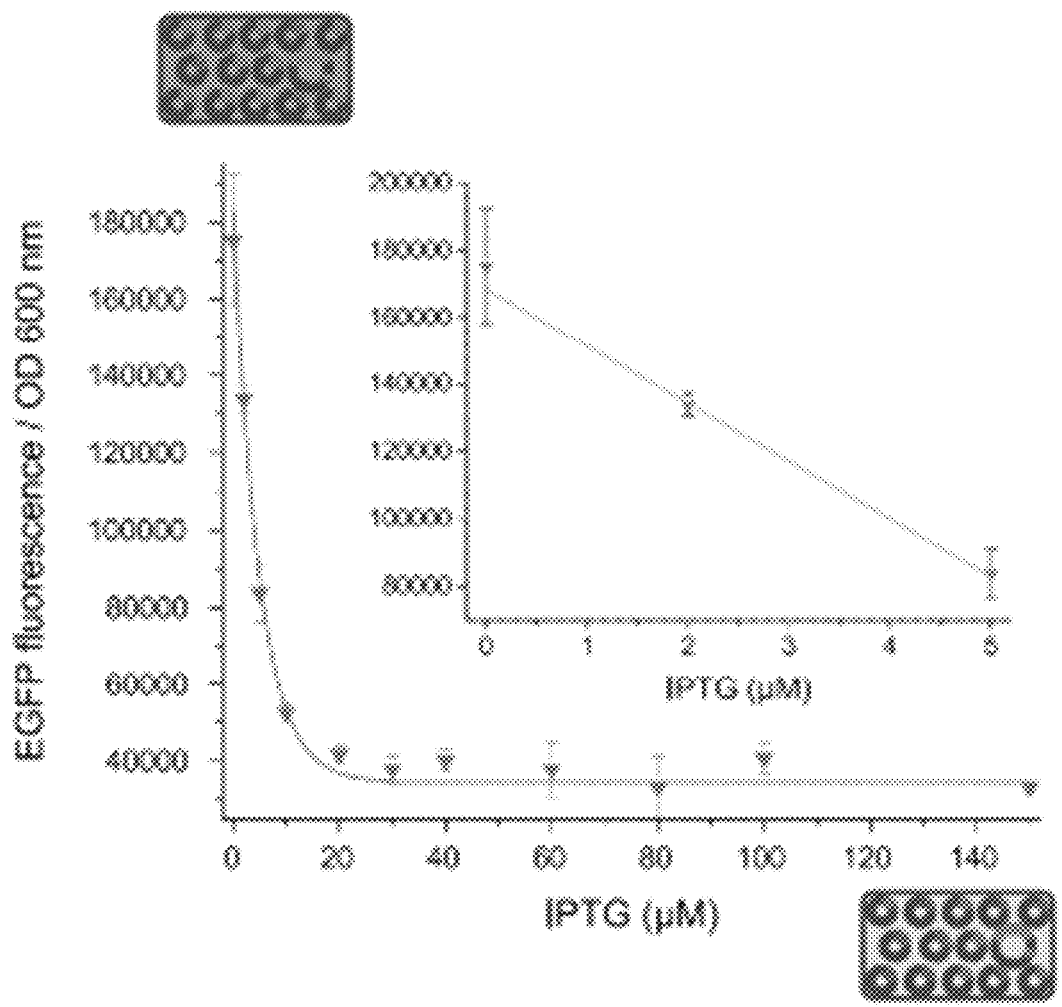
Figure 8:
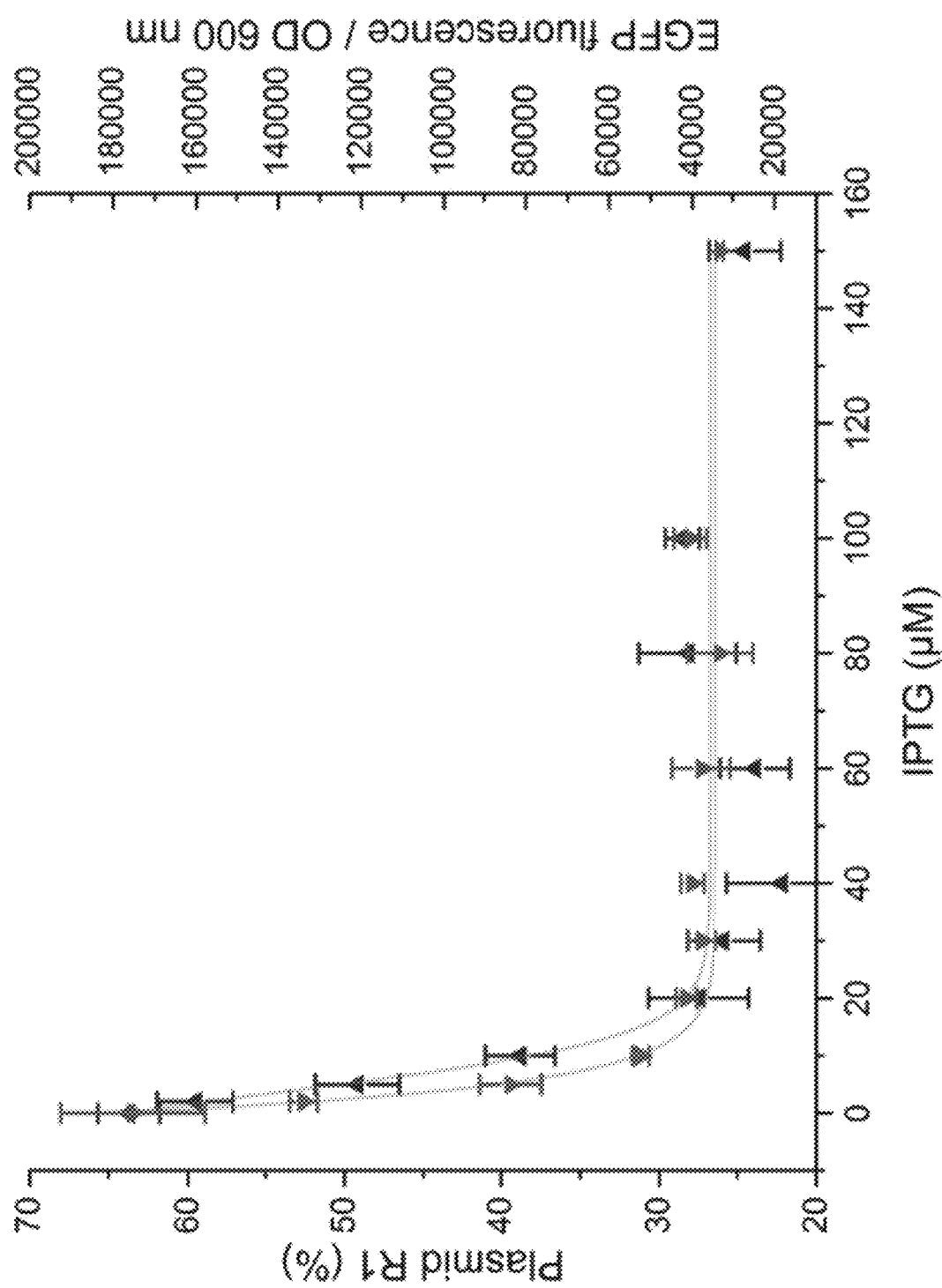
FIG. 8 depicts recording IPTG concentration by CAMERA 1.1 in *E. coli* reported by both the R1 content and EGFP fluorescence. Values and error bars reflect mean EGFP fluorescence or R3 content and the s.d. of three replicates.

One advantage of the CAMERA 1 design is that it records signals in an analog format that can capture more information than binary switches. To explore the analog recording capabilities of CAMERA 1.1, the bacterial culture was treated with different doses of IPTG ranging from 0 to 150 µM with a constant aTc input of 100 ng/mL for 3 hours (FIG. 2B). The R1 content was followed by monitoring EGFP fluorescence and by DNA sequencing. EGFP expression was initiated by diluting the bacterial culture with fresh media lacking aTc or IPTG after the recording process was finished. As anticipated, the EGFP signal decreased as the concentration of IPTG increased, reflecting an increased depletion rate of R1, saturating at 30 µM of IPTG (FIG. 2B). Importantly, the relationship between EGFP loss and IPTG concentration at low dosages ($\leq$ 10 µM) was predictable and linear (FIG. 2B), suggesting that R1:R2 ratio can be used to infer signal amplitude in a reliable manner. HTS of the bacterial culture confirmed these dose-dependent changes in R1:R2 ratio (FIG. 8). Collectively, these findings establish that CAMERA 1.1 can record multiple stimuli of interest in an analog, dose-dependent, and durable manner.

Erasing and Re-Recording of CAMERA 1 Systems

Figure 2C:
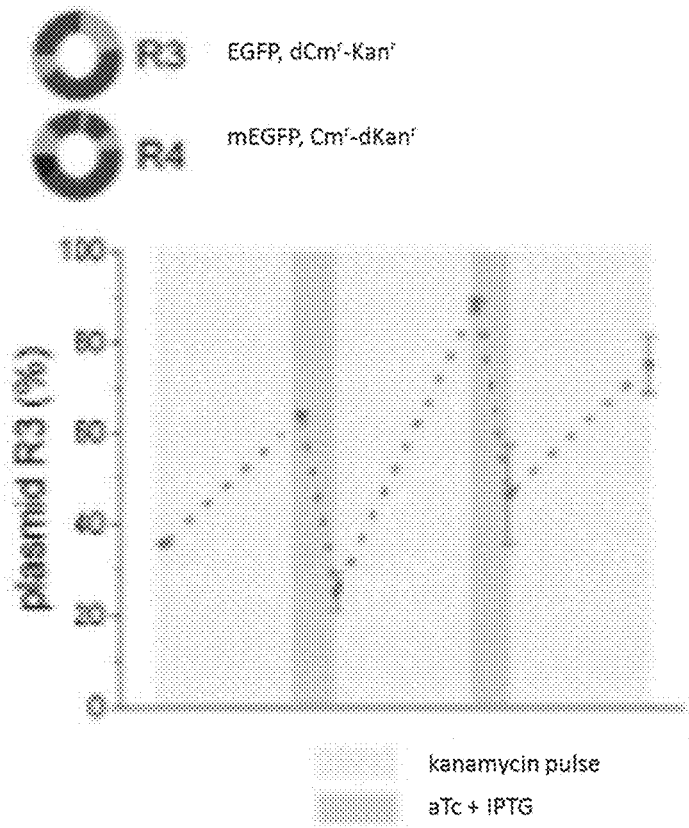

Memory devices are particularly versatile if they can be erased and rewritten as needed. Instead of using R1 and R2, the CAMERA 1.2 system contains two recording plasmids, R3 and R4, that each confer resistance to different antibiotics. Similar to R1, R3 can be targeted by a writing plasmid expressing Cas9 and an sgRNA to cause a shift in the R3:R4 ratio. To minimize the growth advantage between R3 and R4, genes encoding two antibiotic resistance proteins, chloramphenicol acetyltransferase (Cat, which inactivates chloramphenicol), and aminoglycoside-3'-phosphotransferase (Aph3', which targets kanamycin), were fused and a single point mutation in either of the two domains was incorporated. R3 expressed inactive Cat H195A (20) fused to wild-type Aph3', while R4 expressed inactive Aph3' D208A (21) fused to wild-type Cat (FIG. 2C). As both plasmids express two nearly identical proteins, their relative fitness cost in the absence of antibiotic should be minimal. In the presence of either antibiotic, R3 and R4 should confer different fitness benefits.

Figure 9:
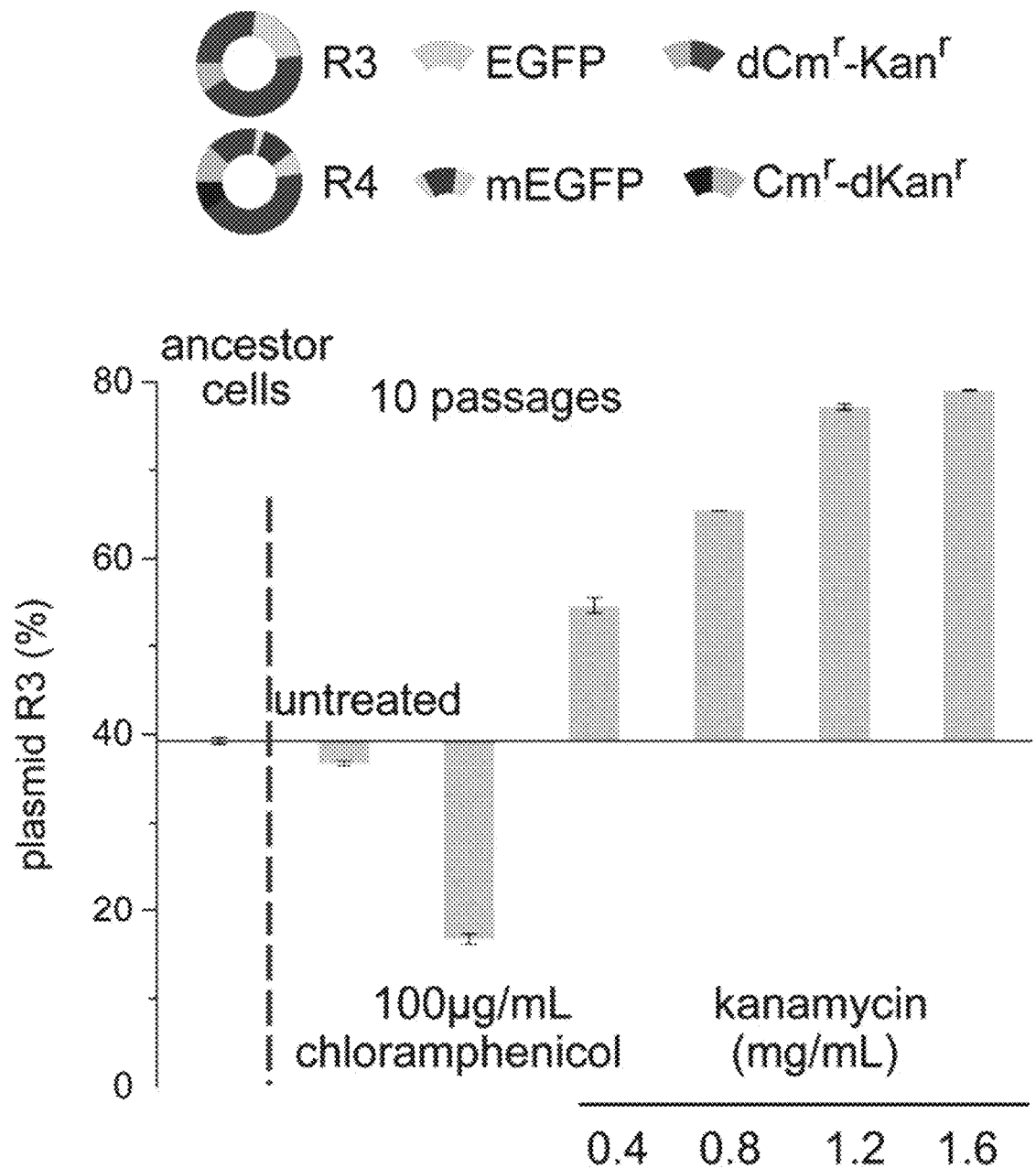
FIG. 9 depicts tuning the recording plasmid ratio in CAMERA 1.2 using antibiotic treatments. Values and error bars reflect mean R3 content and the s.d. of two replicates.

Bacteria containing a starting R3 content of 39% maintained a steady R3:R4 ratio in conditions lacking antibiotic and responded to the presence of chloramphenicol or kanamycin by shifting the plasmid ratio in a highly reproducible, dose-dependent manner favoring the plasmid with the corresponding functional resistance domain (FIG. 9). These results indicate that the information stored in the ratio of R3 and R4 can be reset in either direction using exogenous small molecules. By successively exposing cells to media containing either kanamycin (to reset the R3:R4 ratio to a high level) or aTc+IPTG (to induce Cas9+sgRNA production and cleave R3, lowering the R3:R4 ratio), three successive rounds of erasing and recording using CAMERA 1.2 were performed, with strong response levels in each round (FIG. 2C), demonstrating that this system can be used repeatedly to record and erase exposure to stimuli.

Figure 2D:
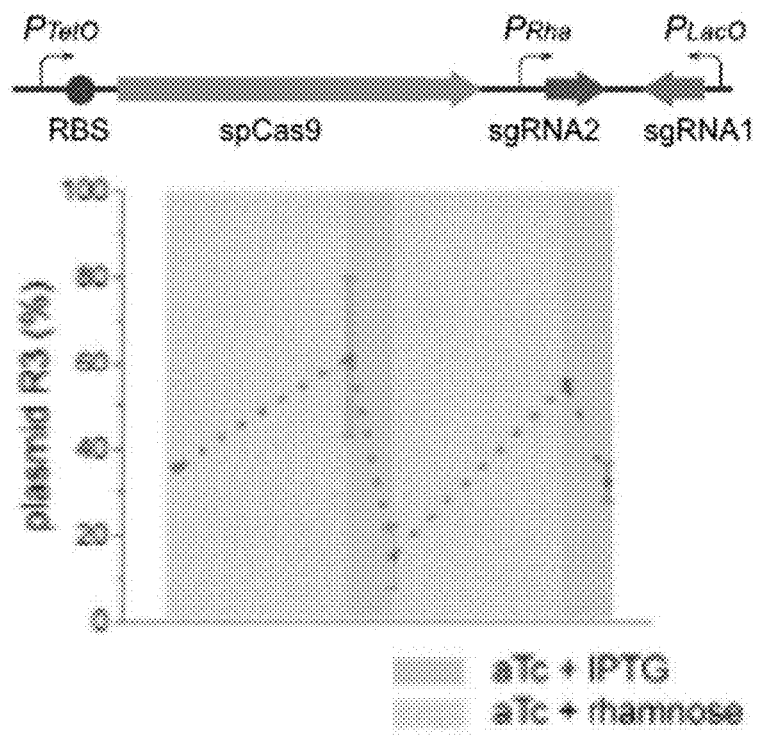
Figure 2E:
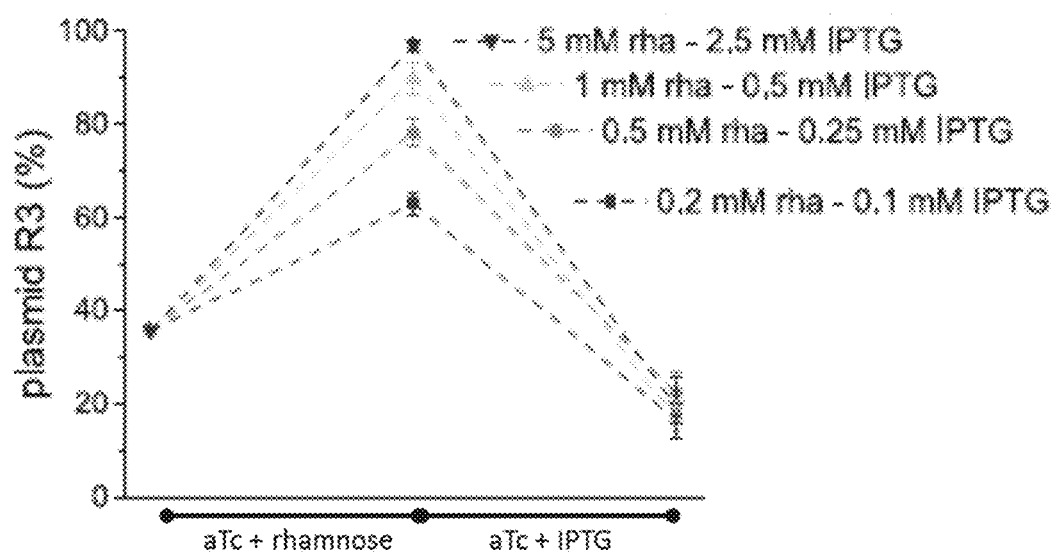
Figure 10:
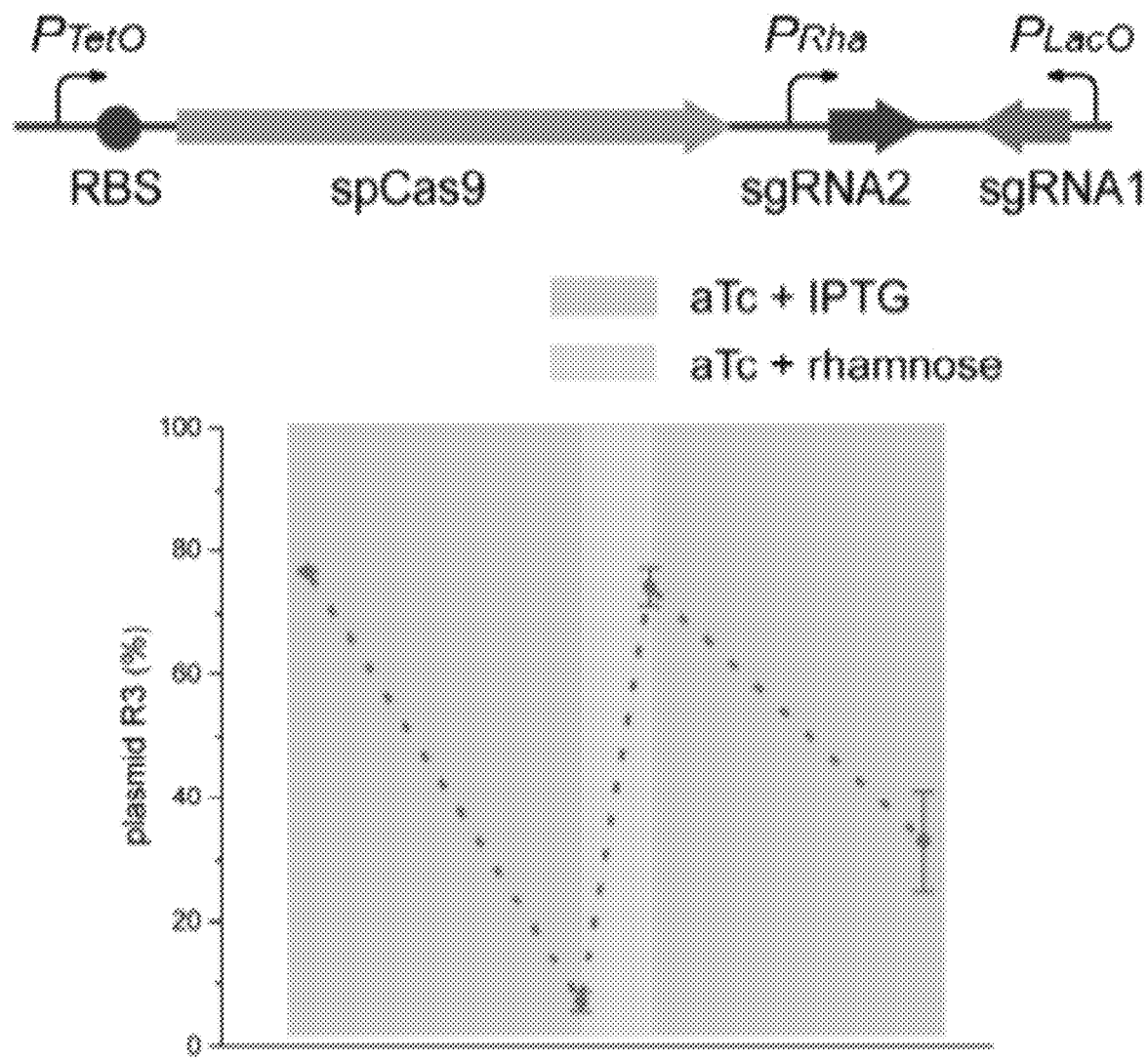
FIG. 10 depicts recording and erasing using CAMERA 1.3 with a starting R3:R4 ratio of 77:23. The values and error bars reflect mean R3 content and the s.d. of three replicates.

An alternative resetting mechanism was developed in CAMERA 1.3 that is independent of antibiotic resistance by including a second sgRNA circuit. In addition to one guide RNA cassette (sgRNA1) present in writing plasmid W1.2 that targets R3, a second guide RNA expression unit was incorporated (sgRNA2) under the control of a rhamnose-inducible promoter ($P_{Rha}$) to generate writing plasmid W1.3. The Cas9:sgRNA2 complex targets plasmids R4. Similar to the recording process in which the expression of sgRNA1 controlled by IPTG results in the loss of R3, the transcription of sgRNA2, induced by rhamnose, should lead to the cleavage of R4, and thus restore plasmid R3 levels. Indeed, E. coli strain S1030 that carried 36% or 77% of R3 successfully went through multiple rounds of recording and erasing upon alternating exposure to rhamnose or IPTG (FIG. 2D, and FIG. 10). In addition, the strength of the stimulus (here, the concentration of rhamnose or IPTG) was reflected in the rate of R3:R4 change (FIG. 2E).

HTS analysis of the recording plasmids after the final round of resetting and recording reveal a minimal frequency ($\leq$ 0.06%) of insertions and deletions (indels) (Table 1), suggesting that Cas9-mediated DNA cleavage does not substantially induce random mutations in the plasmid compensation system in bacteria, and both the recording and erasing processes result in minimal loss of future recording or erasing function. Taken together, these results validate CAMERA 1.2 and 1.3 as rewritable, durable cellular memory devices with distinct resetting mechanisms.

Base Editing Mediates Recording in CAMERA 2

Figure 3A:
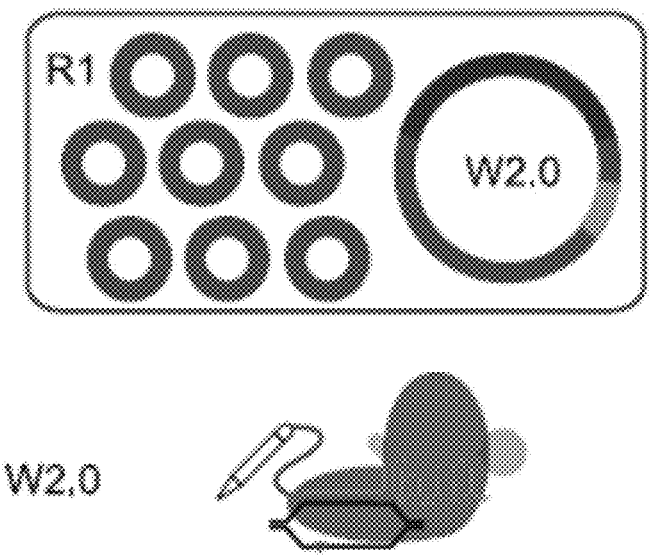
FIGS. 3A-3F depict that CAMERA 2 systems use base editing to record the amplitude and duration of exogenous signals.

Base editors, chimeric proteins consisting of a DNA base modification enzyme, a catalytically impaired CRISPR nickase, and a base excision repair inhibitor (12, 22-24) have been recently developed. Base editors efficiently introduce single C·G to T·A mutations at guide RNA-programmed loci in a wide variety of eukaryotic cells and organisms (12, 13, 25-30). Predictable, durable point mutation of genomic or plasmid DNA by base editing has the potential to serve as an ideal information carrier in synthetic memory devices (FIG. 3A). To incorporate a base editor in CAMERA, first, base editing in E. coli was characterized, as base editors have not been extensively used in prokaryotic cells. Since bacteria lack nick-directed mismatch repair exploited by the third-generation base editor (BE3), the second-generation base editor (BE2) was used that contains a cytidine deaminase fused to a catalytically dead Cas9 (dCas9), rather than to a Cas9 nickase, as the protein component of the writing complex (12).

Figure 3B:
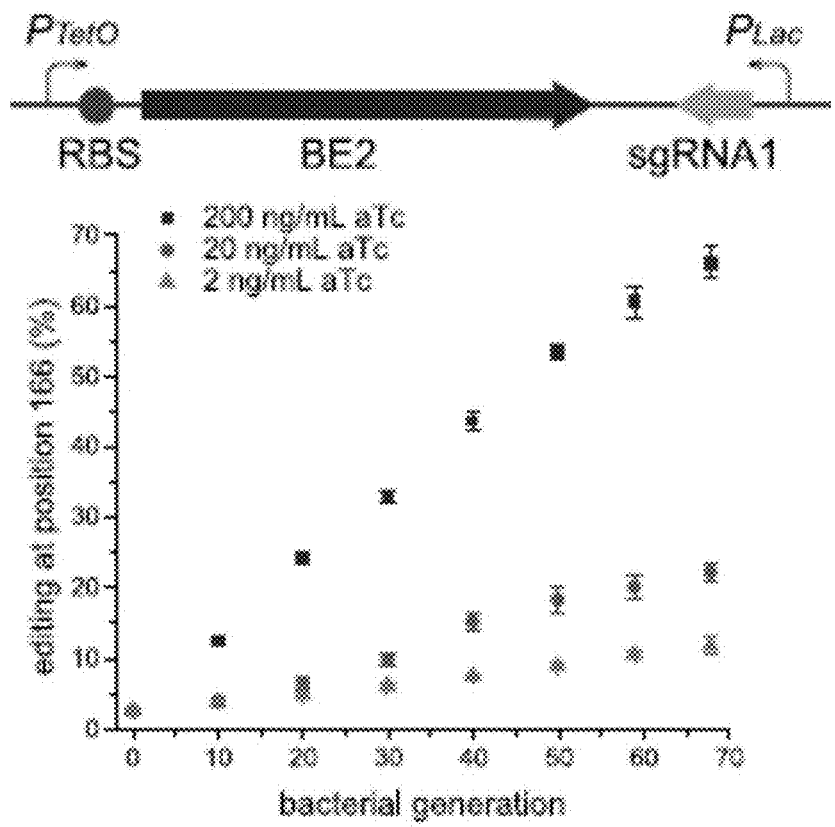

In writing plasmid 2.0 (W2.0), BE2 expression is induced by aTc and sgRNA1 is constitutively transcribed (FIG. 3A). To test whether CAMERA 2.0, constructed using W2.0 and recording plasmid R1, can faithfully record the amplitude and duration of an exogenous signal, the bacterial culture was treated with aTc at different concentrations and diluted repeatedly to ensure constant expression of the writing complex. When complexed with BE2, sgRNA1 introduces a C·G to T·A mutation at position 166 of the EGFP gene in recording plasmid R1. As anticipated, base editing occurred in an analog mode and the total percentage of modified base increased with bacterial passage number in a highly linear and remarkably reproducible relationship (FIG. 3B). This observation indicates that base editing with BE2 in bacteria is robust and cumulative, reflecting the duration of exposure to the stimulus that induces expression of the writing complex (FIG. 3B). Moreover, the rate of editing can be controlled in a dose-dependent manner (FIG. 3B). By the end of the experiment (68 passages), 66% editing was observed with 200 ng/mL aTc and no significant decrease in editing rate was observed as the recording proceeded, suggesting that given enough time, base editing could approach 100% in bacteria (FIG. 3B).

Importantly, editing at the target locus accumulated at a slow but constant rate when aTc was present at a low concentration of 2 ng/ml (FIG. 3B). Under these low induction conditions, only 12% of the total recording range (G·C to A·T conversion at position 166 of the EGFP gene) was consumed by bacterial generation 68 (FIG. 3B), suggesting that CAMERA 2.0 can function as a molecular clock that records over hundreds of generations. Collectively, these findings establish CAMERA 2.0 is a highly responsive analog memory device that uses base editing to faithfully record the amplitude and the duration of an exogenous signal in the form of single nucleotide changes over long time scales.

Recording of Multiple Stimuli Using CAMERA 2 Systems

Figure 3C:
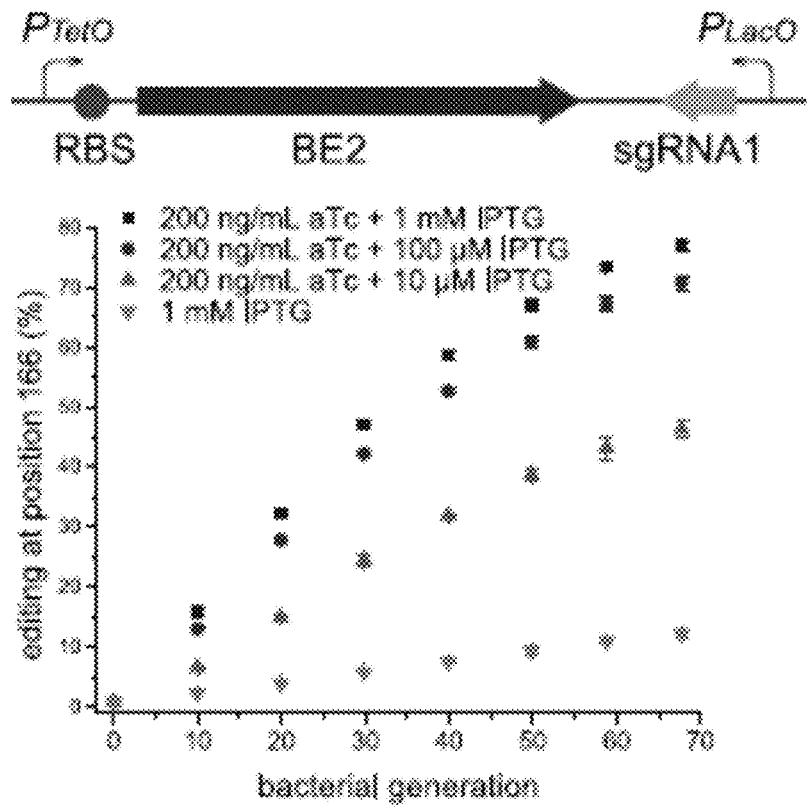
Figure 11C:
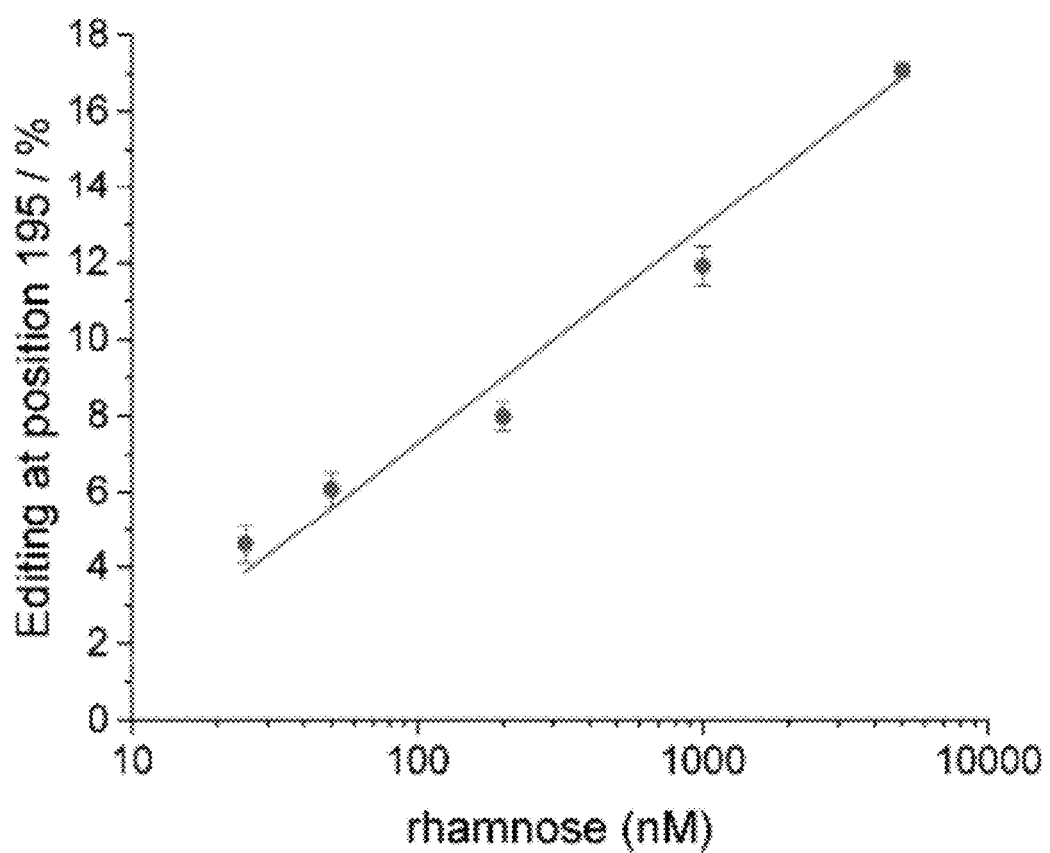

Additional base editor writing plasmids W2.1, W2.2 and W2.3 were constructed by replacing the Lac promoter of the guide RNA in writing plasmid W2.0 with promoters regulated by IPTG, arabinose, and rhamnose, respectively, to generate devices CAMERA 2.1, 2.2, and 2.3 (FIG. 3C, and FIG. 11). Similar to CAMERA 2.0, writing promoted by the BE2:sgRNA1 complex in CAMERA 2.1 occurred in a highly reproducible, predictable, and dose-dependent manner (FIG. 3C). The leaky transcription of the TetO promoter enabled very slow but steady recording in the absence of aTc, whereas the recording space was consumed at a much faster speed at the presence of both IPTG and aTc (FIG. 3C).

Figure 3D:
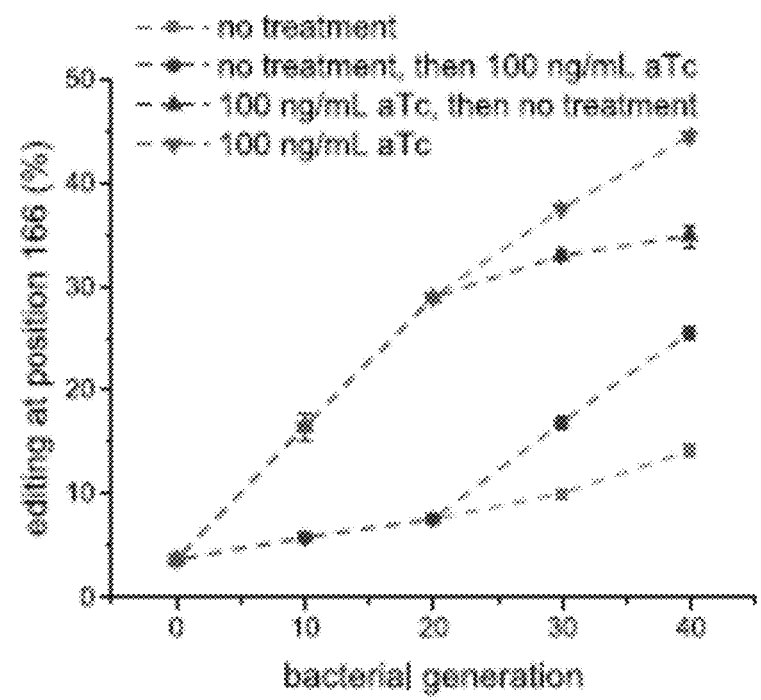
Figure 3E:
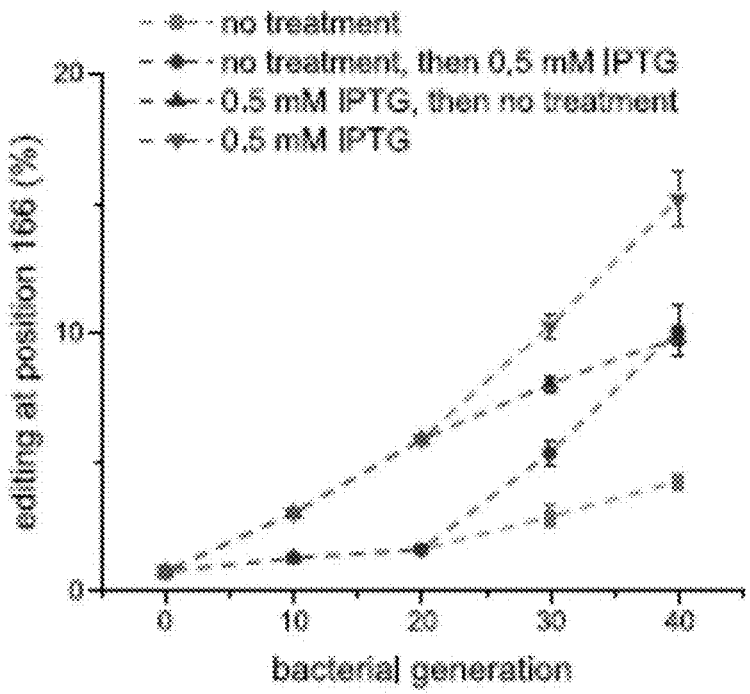

To test whether the information recorded in CAMERA can be used to deduce the total exposure time of the device to a stimulus, bacteria carrying CAMERA 2.0 were passed for 40 generations and either the first 20 generations or the second 20 generations were treated with 100 ng/mL aTc (FIG. 3D). The accumulation rate of editing at position 166 of the EGFP gene was strongly determined by exposure duration, and the presence or absence of aTc within a certain time window could be determined by comparing the editing rate of the sample with those of control samples that were always exposed to, or always shielded from, the stimulus (FIG. 3D). Similarly, bacteria carrying CAMERA 2.1 were treated with 0.5 mM IPTG for either the first half or the second half of the total incubation time (FIG. 3E). The editing rate strongly correlated with the presence of IPTG and the total accumulated editing frequencies in the two groups were nearly identical by the end of the experiment, suggesting that the information recorded by CAMERA 2.1 faithfully reflected the duration of exposure to the signal, regardless of when the exposure took place (FIG. 3E). Collectively, these observations confirm the robustness and reproducibility of the recording process and suggest that the extent of base editing at a known time point can be used to deduce the dose of the stimulus, and that the stimulus duration can be calculated from the total base editing conversion if the stimulus dose is known.

The presence of both aTc and a second stimulus is required for CAMERA 2.1, 2.2, and 2.3 to initiate recording, a process that mimics the behavior of an "AND" gate. Indeed, in the absence of stimuli, CAMERA 2.2 showed no detectable activity, with ≤ 0.1% C·G to T·A editing at position 186 of the EGFP gene (FIG. 11). Neither arabinose nor aTc by itself increased editing significantly (FIG. 11). However, the presence of both inducers resulted in 9.0% C·G to T·A conversion after 24 hours (FIG. 11), suggesting that CAMERA 2.2 functions as a tightly regulated "AND" gate. Similarly, both rhamnose and aTc were required to initiate recording at position 186 of the EGFP gene by CAMERA 2.3 (FIG. 11). The recording efficiency was tested at different concentrations of rhamnose in the presence of 200 ng/ml aTc and it was confirmed that C·G to T·A conversion at position 195 correlated well with the dose of rhamnose (FIG. 11), again demonstrating that signal intensity can be faithfully recorded and stored by CAMERA 2 systems.

Figure 3F:
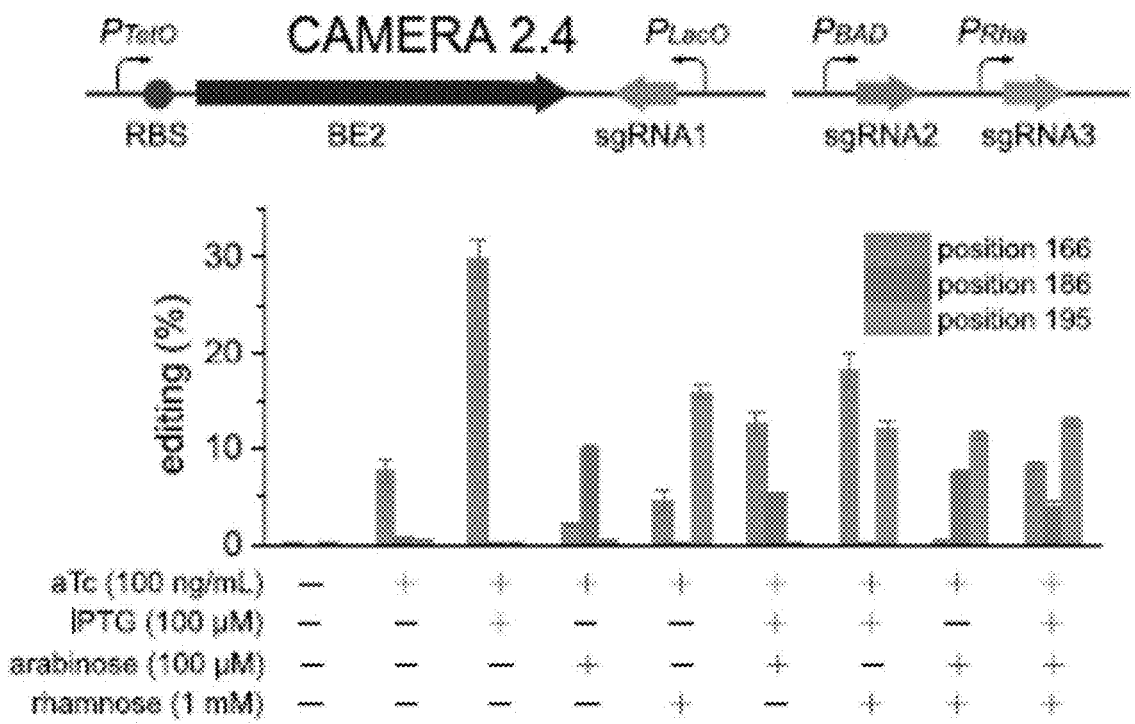

One advantage of adapting CRISPR technologies to build synthetic memory devices is that multiple stimuli in theory can be recorded using multiple guide RNA units. To test whether CAMERA can simultaneously record multiple independent signals, all three small molecule-responsive guide RNA expression circuits from writing plasmids W2.1-2.3 were integrated into writing plasmid W2.4. Bacteria carrying CAMERA 2.4 were treated with different combinations of the four small-molecule inducers and indeed, editing at the designated EGFP positions could be used to predict the presence of the corresponding writing complexes and hence their corresponding stimuli (FIG. 3F). Thus the fidelity of the device is not compromised even in more complicated environments in which more than two stimuli are provided, suggesting that CAMERA 2 is a versatile and multiplexable memory device.

Recording Event Order Using CAMERA 2 Systems

Figure 4A:
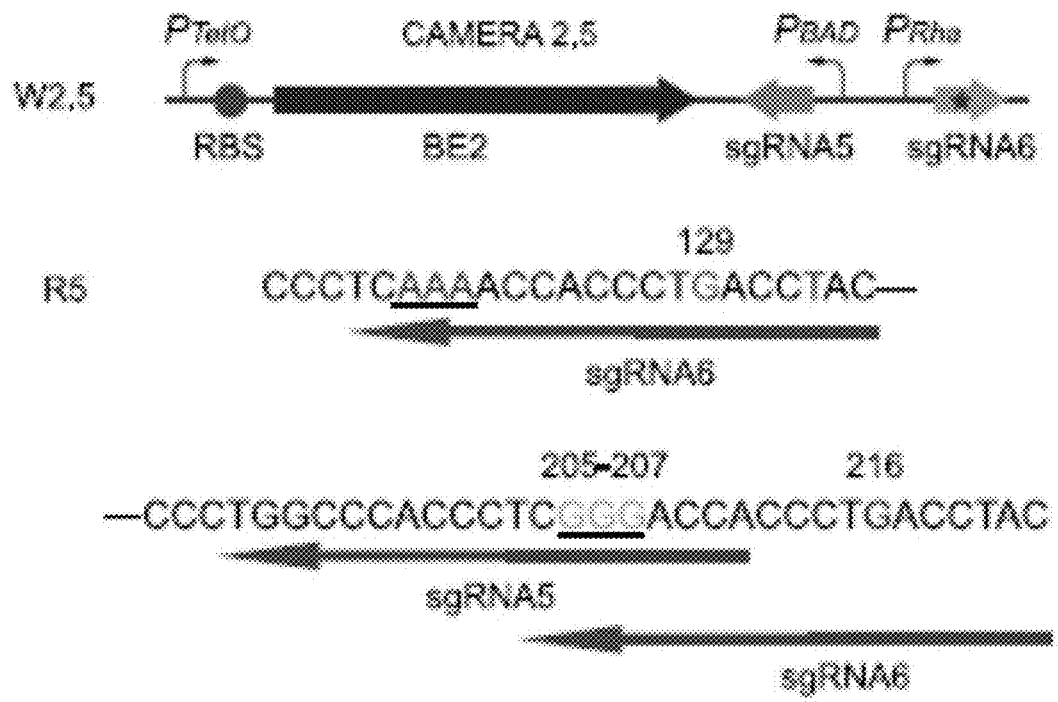
FIGS. 4A-4E depict that CAMERA 2 systems can record the order of stimuli and a wide range of environmental signals.

Memory devices that are capable of recording the order of biological events are of great interest (3), as the order of changes in a cell's environment or in the state of a cell can strongly determine cell fate (31). Murray and coworkers recently described a two-input temporal logic gate to record the order and timing of inputs, but the limited number of possible output states (GFP, RFP, or neither) necessitated the sharing of the same output among five different combinations of ordered inputs, complicating the assignment of multiple cell states (32). It was hypothesized that CAMERA 2 systems could record events that occur in a specific order by overlapping two base editing targets such that base editing of DNA target 1 mediated by writing complex 1 (BE2:sgRNA5) is required before DNA target 2 can be recognized by writing complex 2 (BE2:sgRNA6). To test this possibility, CAMERA 2.5 was constructed, in which the order of exposure to two small molecule inducers, arabinose and rhamnose, could be recorded (FIG. 4A). The three arabinose-induced C·G to T·A modifications resulting from base editing by writing complex 1 are located within target site 2 near its PAM. Rhamnose-induced sgRNA6 targets target site 2 only after modification by writing complex 1, but should not edit this site before base editing by writing complex 1 has taken place (FIG. 4A). Thus base editing at position 216 should only be initiated if rhamnose (stimulus 2) was provided after arabinose (stimulus 1), but not if the order of stimuli is reversed.

Figure 4B:
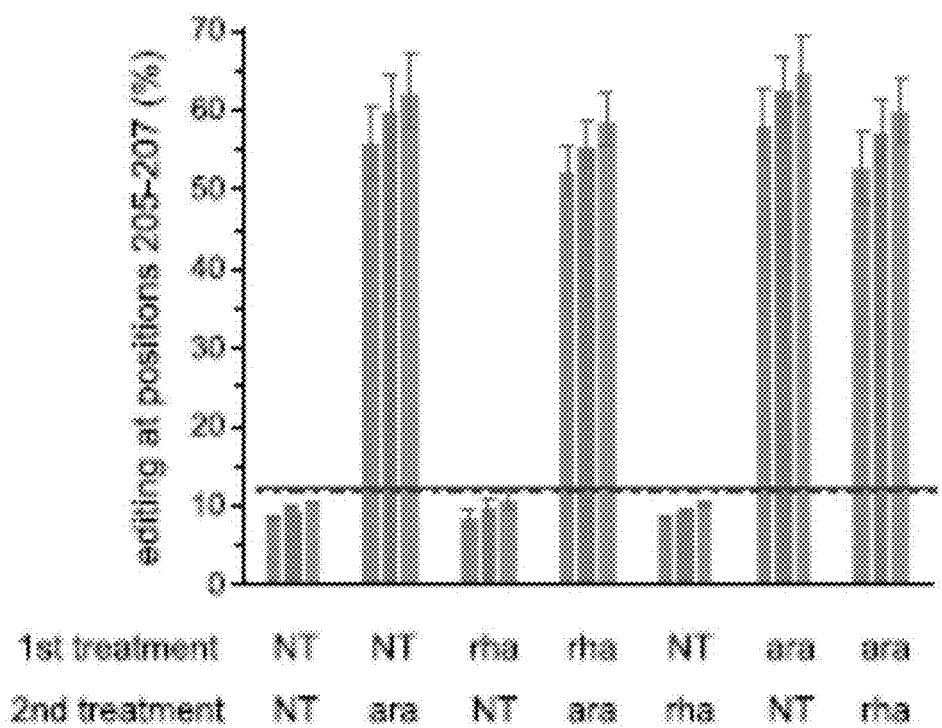
Figure 4C:
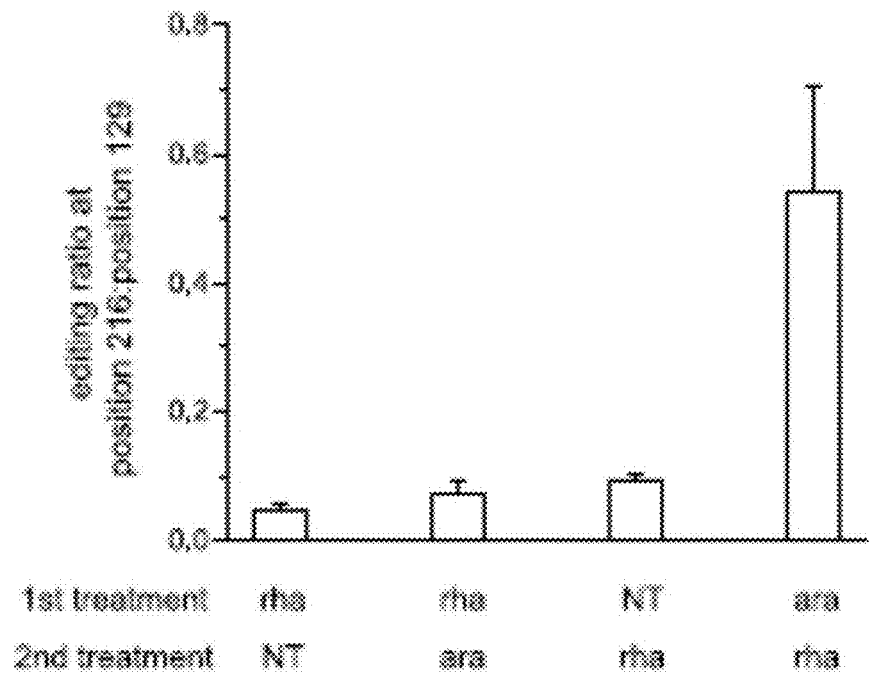
Figure 12:
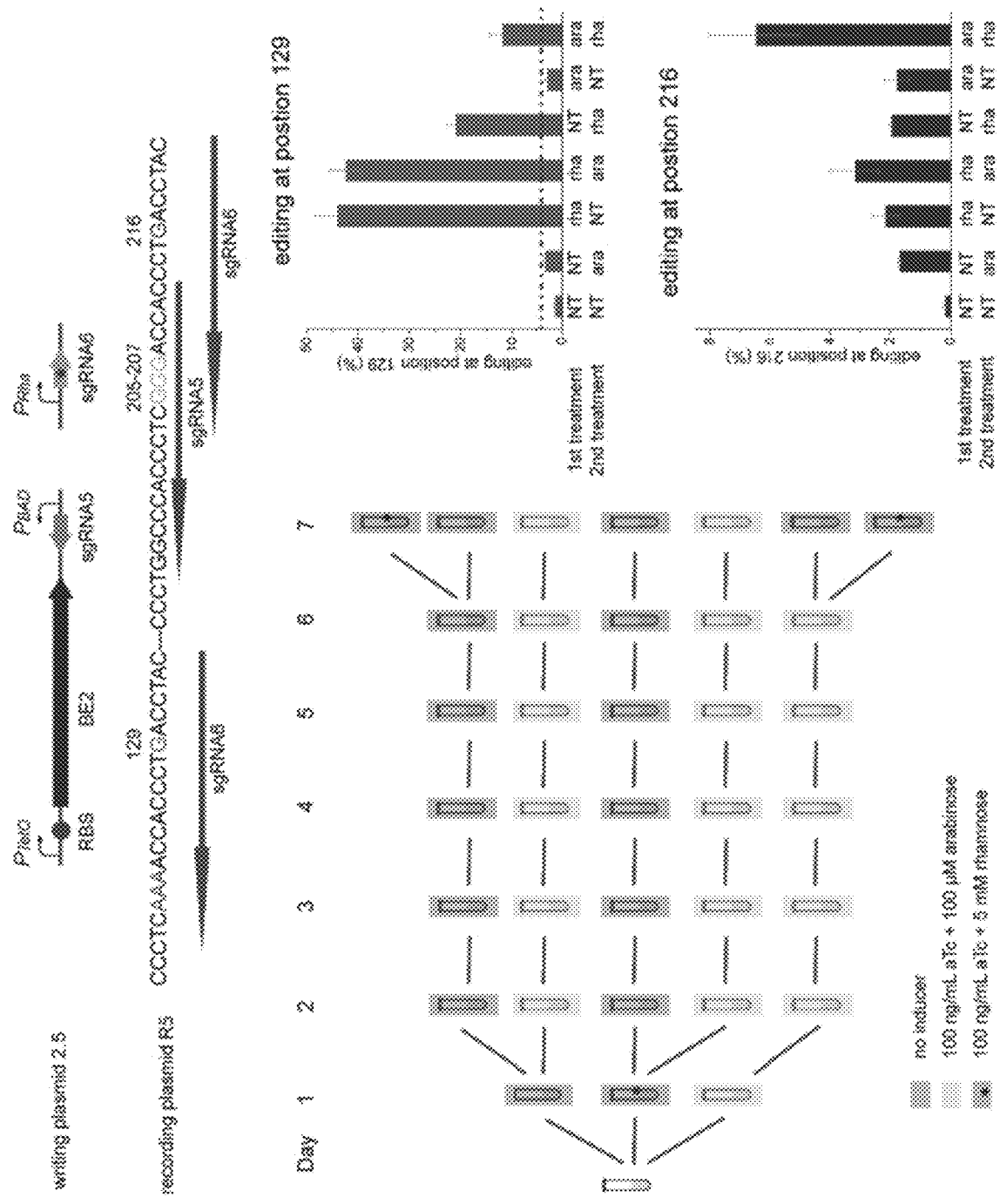
FIG. 12 depicts the sequence of arabinose and rhamnose exposures as reflected in CAMERA 2.5 recording, depicting editing at positions 129 (SEQ ID NO. 864) and positions 205-207 and 216 (SEQ ID NO. 865). The inducer application schedule is shown in the lower left. The presence of arabinose results in the C:G to T:A modifications at positions 205-207, whereas the C:G to T:A editing at position 129 reflects the bacterial encounter of rhamnose. Base editing at position 216 is dependent on the order of exposure to stimulus, with arabinose followed by rhamnose resulting in the strongest recording signal. The ratio of position 216 editing:position 129 editing strongly indicates order of exposure (see FIGS. 4A-4E). The values and error bars reflect mean editing at the corresponding positions and the s.d. of three replicates.

By using an additional target site of sgRNA 6 spanning positions 116-135 of a modified EGFP gene, CAMERA 2.5 is further equipped with the ability to independently record two stimuli (FIG. 4A). While editing at positions 205-207 and 129 record exposure to arabinose and rhamnose (FIG. 4B and FIG. 12), respectively, the ratio of base editing at position 216 compared to position 129, both promoted by writing complex 2, reflects the order of application of the two stimuli (FIG. 4C). The activating treatment order of arabinose followed by rhamnose resulted in a position 216:129 base editing ratio of 0.54. When the treatment order was reversed such that rhamnose exposure precedes arabinose, this ratio was 6.8-fold lower (0.08) (FIG. 4C). Together, these results indicate that CAMERA 2.5 can record cellular events in a strongly order-dependent manner.

Recording of Phage Infection and Light Using CAMERA 2.0 Derivatives

Figure 4D:
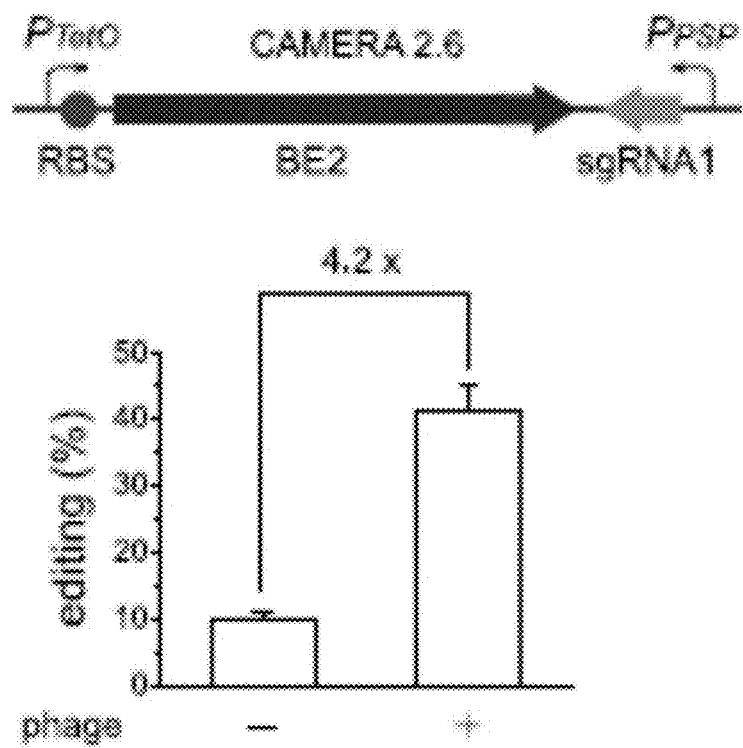

The CAMERA 2.0 architecture in bacteria was applied to sense viral infection of host cells by bacteriophage, and exposure to light. A phage shock promoter (PSP) driving sgRNA1 transcription was included in CAMERA 2.6 (FIG. 4D) (33, 34). Without phage infection, 9% base editing was observed at EGFP position 166 (FIG. 4D), consistent with previous reports of background transcriptional activity of PSP in the absence of phage (35). Base editing at position 166 increased 4.7-fold to 42% following infection with phage (FIG. 4D). Similarly, using a light-responsive expression system based on light-inhibited interaction of YF1 and FixJ and activation of $P_{FixK2}$, CAMERA 2.7 could record the presence of light with a 59-fold increase in recording site editing efficiency (FIG. 4E) (36). These results collectively demonstrate that the CAMERA 2 is capable of recording as single-nucleotide changes in bacterial DNA a wide range of signals, including exposure to antibiotics, nutrients, viruses, and light.

Figure 4E:
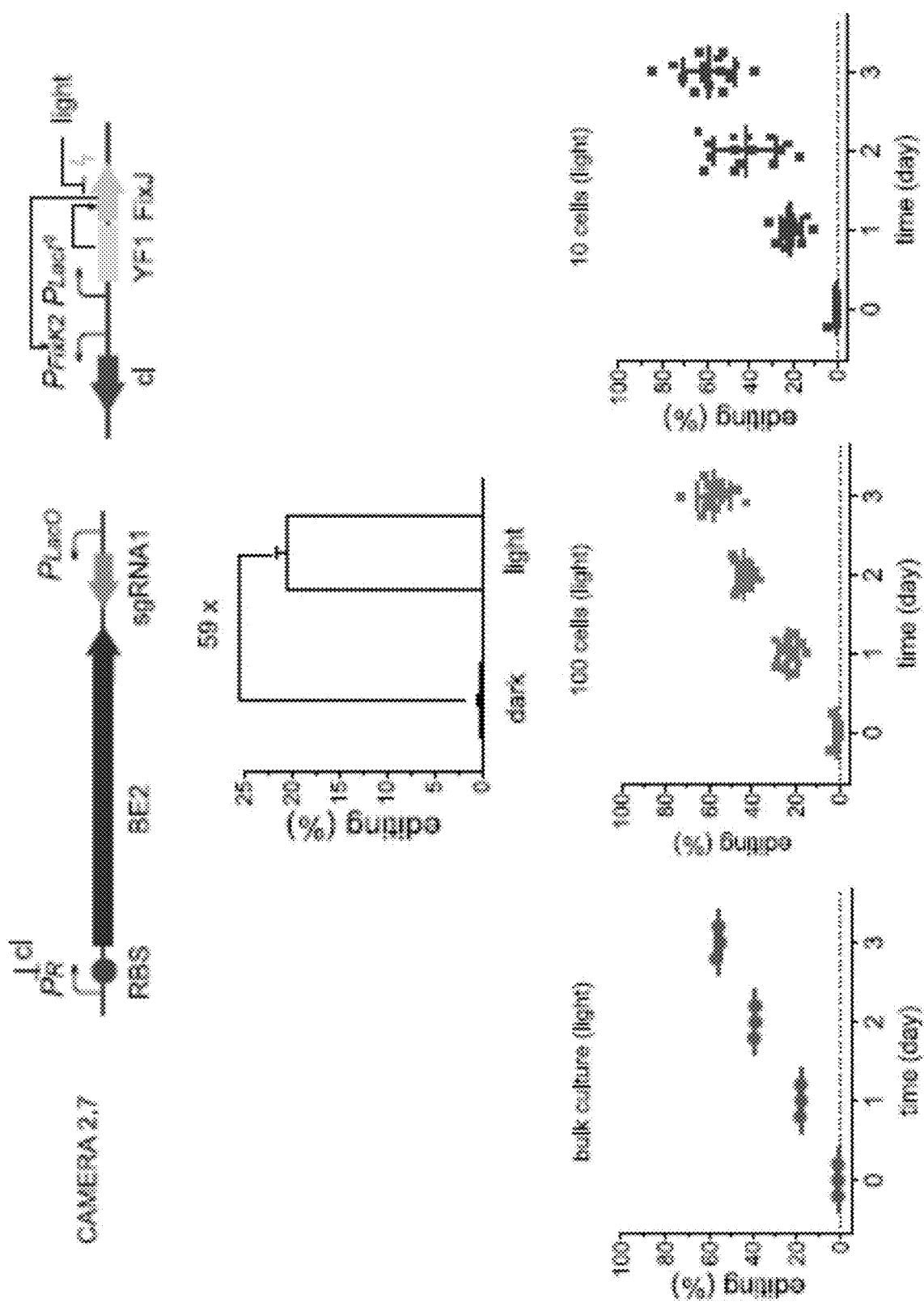
Figure 13:
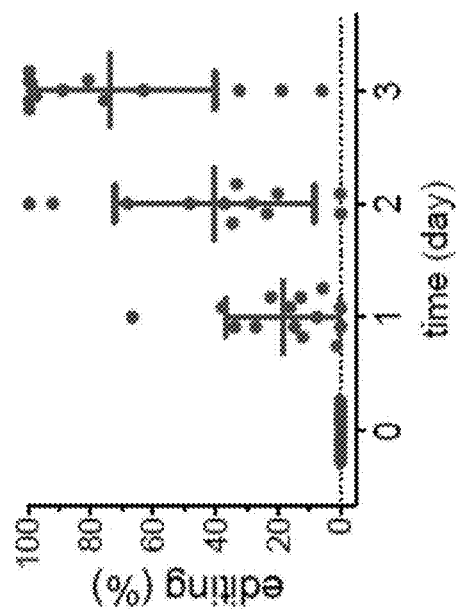
FIG. 13 depicts the light exposure recording with CAMERA 2.7 at the single-cell level. The values and error bars in dot plots represent mean editing and the s.d. of 15 replicates of randomly sorted cells.

In principle, the recording process carried out by CAMERA systems should not require a large population of cells because the recording plasmid is present in hundreds of copies in each cell. To test the possibility of recording and reading CAMERA data in small cell populations, how light exposure was recorded by CAMERA 2.7 in a handful of cells as well as at the single-cell level (FIG. 4E and FIG. 13) was characterized. As expected, CAMERA 2.7 reliably recorded bacterial exposure to light in bulk cultures, with editing at EGFP position 166 in ~$10^6$ cells increasing in a linear fashion with light exposure duration (from 1.2% to 57% editing over three days, FIG. 4E). Importantly, reliable recording and signal readout were also achieved using only 100-cell or 10-cell samples throughout the three-day recording process, although larger variations were observed with fewer cells, as expected (FIG. 4E). Even measuring 15 single-cell signals yielded similar average light duration-dependent editing efficiencies as those from bulk cultures (FIG. 13). These data demonstrate that CAMERA can support analog-like recording even in small populations of only 10-100 cells.

CAMERA 2m Systems Record Cell States in Mammalian Cells

Figure 5A:
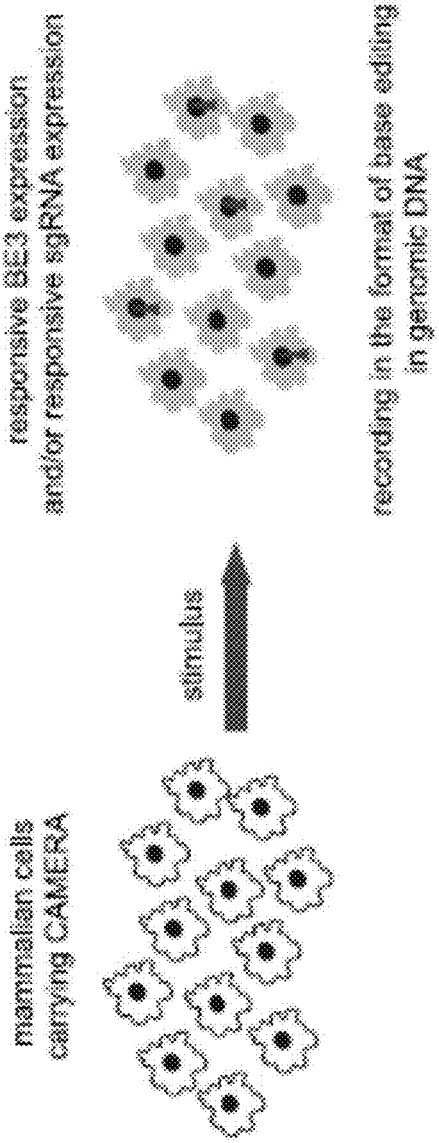
FIGS. 5A-5E depict CAMERA 2m recordings in mammalian cells, where the "m" denotes CAMERA systems for recording in mammalian cells.
Figure 5B:
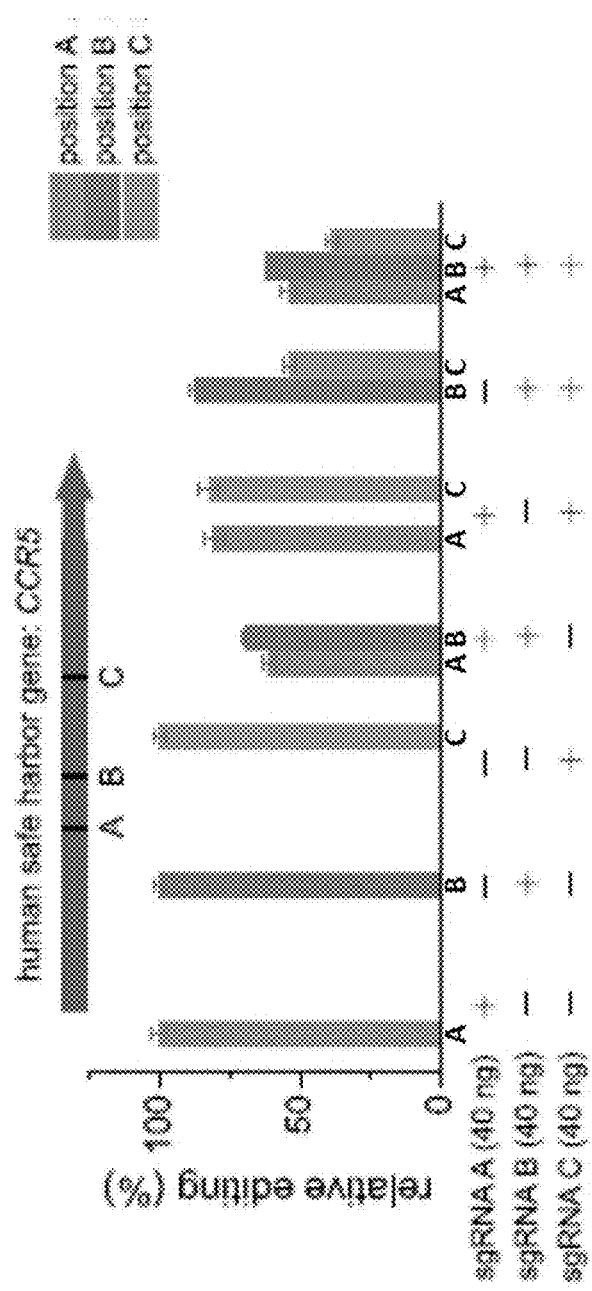
Figure 14:
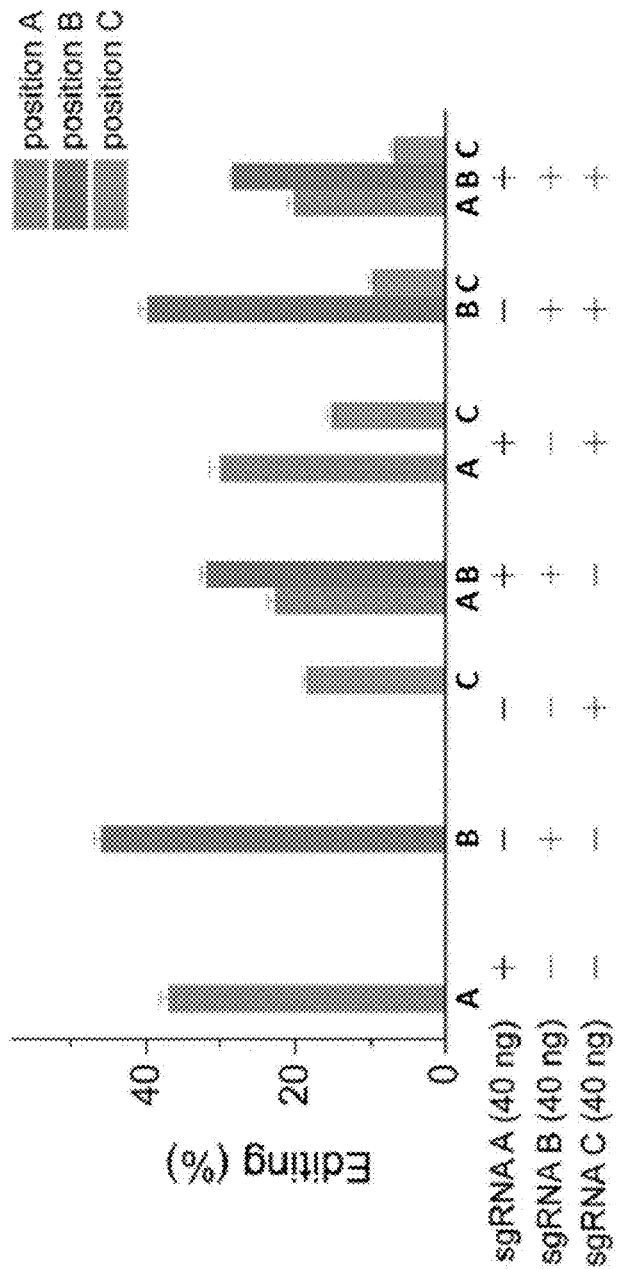
FIG. 14 depicts the raw base editing efficiencies for CAMERA 2 in mammalian cells targeting the human safe harbor gene CCR5. The values and error bars reflect mean base editing efficiencies at the corresponding positions and the s.d. of three replicates.

Finally, a CAMERA 2 variant in human HEK293T cells was tested and an established human safe harbor gene, CCR5 (37), was chosen as the recording locus (FIG. 5A). Three individual sgRNAs were designed that target different regions of the CCR5 gene (CAMERA 2 m.0, FIG. 5B and FIG. 14). Total C·G to T·A editing of 37%, 46%, or 19% was obtained at target positions A, B, or C of the CCR5 gene when using corresponding guide RNAs A, B, or C with BE3 (FIG. 14). The C·G to T·A conversion frequency at each site increased a minimum of 270-fold compared with controls lacking the corresponding guide RNA. Robust multiplexed recording was also achieved using the three sgRNAs in all possible combinations and less than 0.07% editing was observed at any site for which the corresponding guide RNA was not supplied, suggesting that base editing cross-talk between guide RNAs is minimal in these human cells.

Figures 5C, 5D:
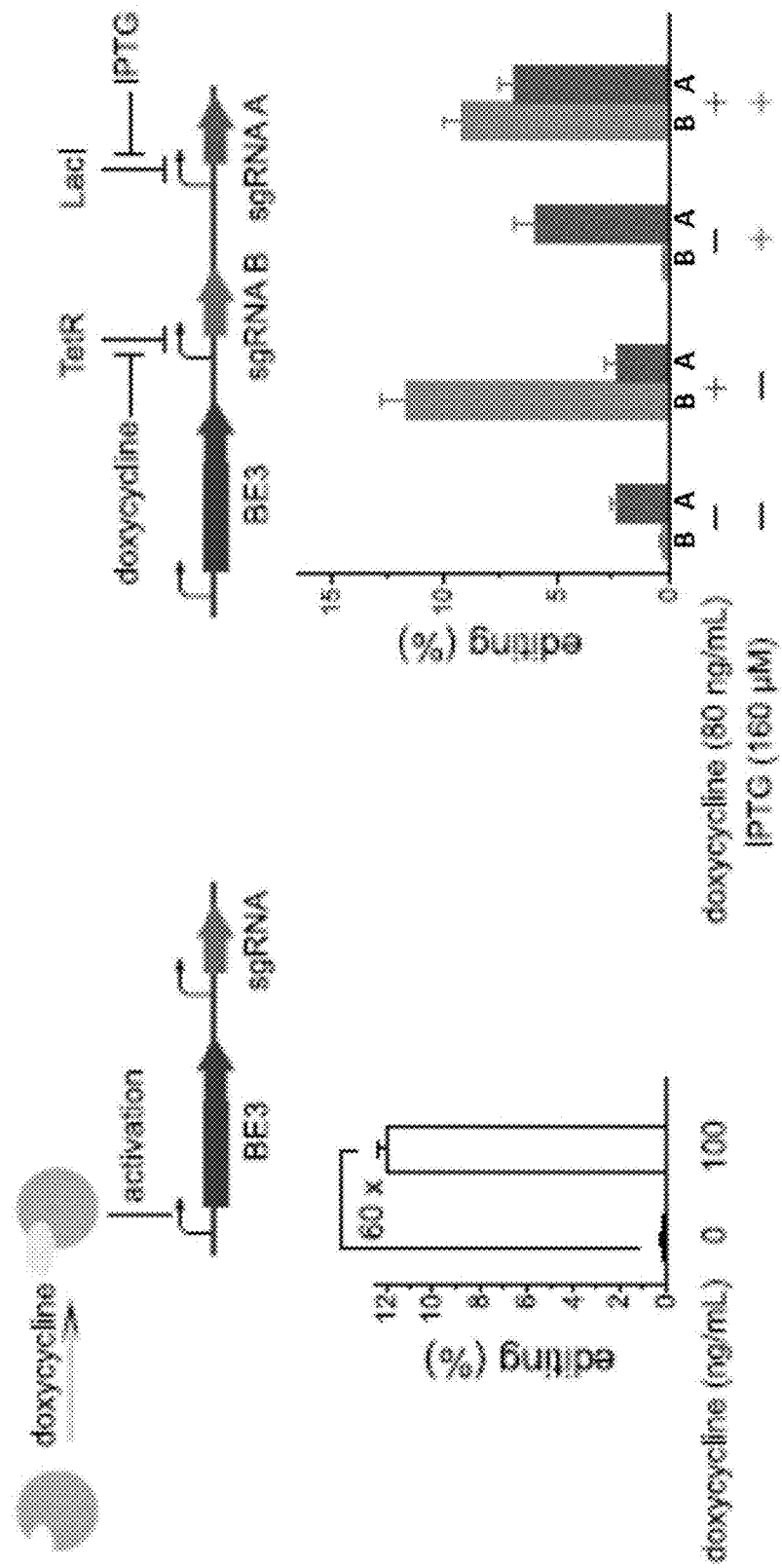

By placing BE3 expression under doxycycline-induced control, the presence of the drug was recorded in the CCR5 loci with a base editing frequency 60-fold higher than in cells that never encountered doxycycline (CAMERA 2 m.1, FIG. 5C). Further, by placing sgRNA expression under TetR and LacI suppressed promoters, CAMERA 2 m.1 recorded the presence of both doxycycline and IPTG at different positions in the CCR5 loci (CAMERA 2 m.2, FIG. 5D), confirming that CAMERA 2m can be multiplexed to record combinations of inputs in human cells.

Figure 5E:
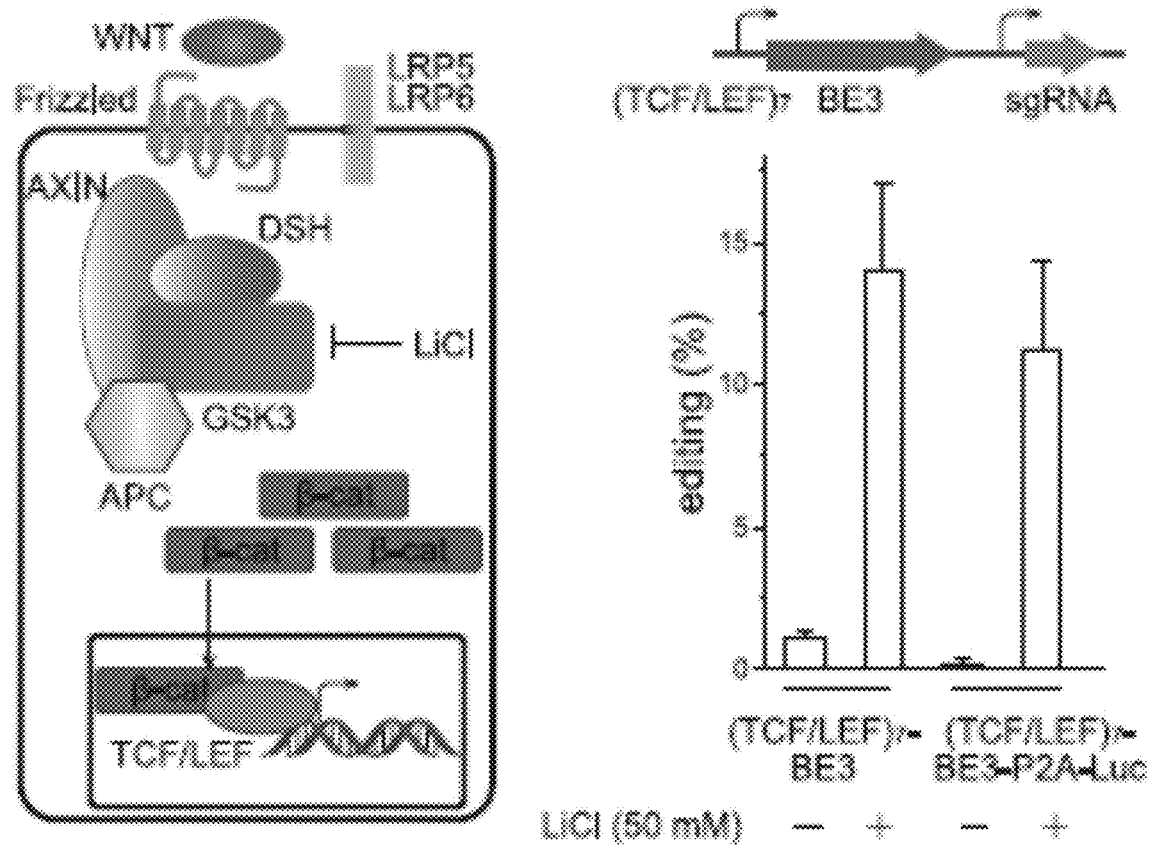
Figure 15:
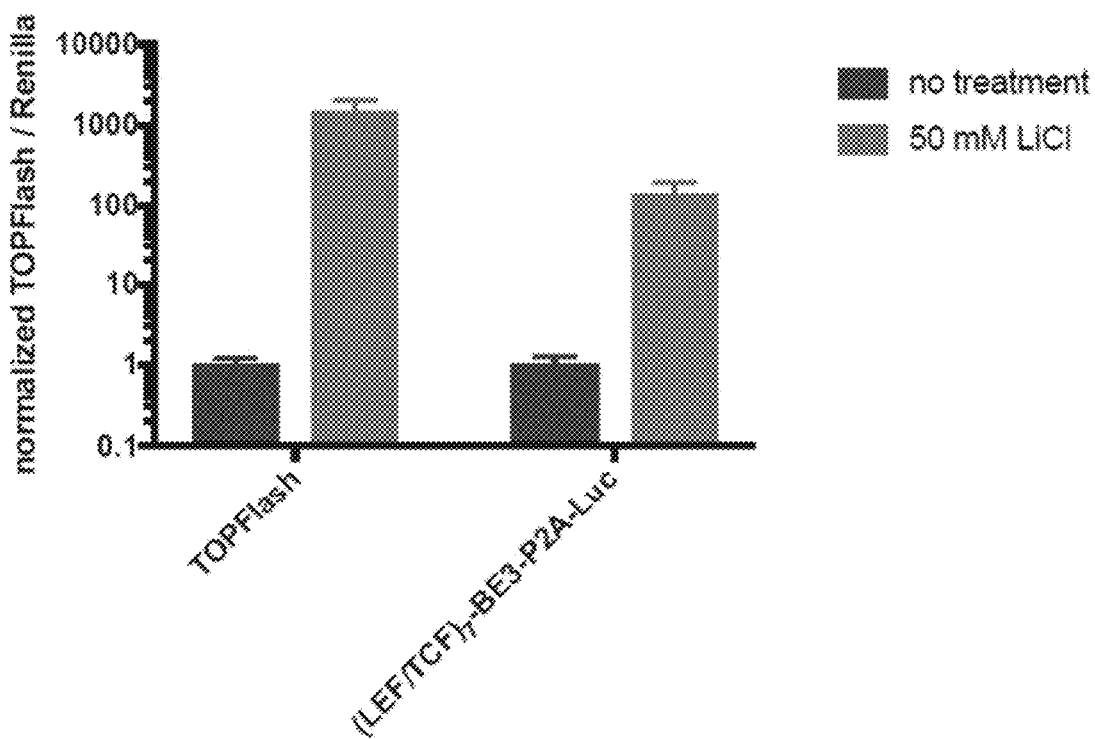
FIG. 15 depicts luciferase activation in HEK293T cells carrying (LEF-TCF)$_7$-Luc (TOP-Flash) and (LEF-TCF)$_7$-BE3-P2A-Luc upon LiCl treatment. A plasmid that encodes the Renilla luciferase gene was co-transfected to normalize transfection efficiency. The values and error bars reflect mean Firefly luciferase/Renilla luciferase ratio in treated sample normalized to that of untreated cells and the s.d. of three replicates.

The Wnt signaling pathway (also known as a signaling cascade) plays a crucial role in embryonic development and aberrant Wnt signaling is associated with a variety of diseases in humans (38). A recording of Wnt signaling was sought using CAMERA 2m in human cells. To achieve this goal, the expression of BE3 was placed under a (LEF-TCF)$_7$ promoter (39) that responds to Wnt signaling to initiate downstream gene expression in CAMERA 2 m.3. Cells transfected with CAMERA 2 m.3 were treated with LiCl, a GSK3 inhibitor that has been demonstrated to activate Wnt signaling (FIG. 5E) (40). A (LEF-TCF)$_7$-BE3-P2A-Luc construct that expresses a firefly luciferase protein together with BE3 was included so that Wnt could be monitored simultaneously by luminescence and by high-throughput sequencing of the CCR5 recording locus. As expected, cells transfected with (LEF-TCF)$_7$-BE3-P2A-Luc exhibited a large (140-fold) increase in Wnt signaling-driven luciferase expression upon LiCl treatment (FIG. 15). This increase in Wnt signaling was permanently recorded by a 53-fold increase in base editing at the CCR5 locus upon LiCl treatment (FIG. 5E). These results demonstrate that Wnt signaling, a major endogenous mammalian signaling pathway, can be recorded by CAMERA 2m in human cells.

Recording of Endogenous Pathways in Mammalian Cells

In order to evaluate the versatility and applicability of methods provided herein, the CAMERA 2 system, as employed in the Wnt pathway hereinabove, was used in human cells (HEK293T) and validated with exogenous stimulatory molecules (i.e., peptides, small molecules, and/or antibiotics) by observing single-base changes at the safe-harbor locus in the human genome and/or by luciferase luminescence. Briefly, and similarly as above, the expression of the base editor (e.g. BE3) was driven by a promoter responsive to the specific pathway to being recorded (e.g., see NFκB, CREB, SMAD, etc. in FIG. 16 and Table 10) to initiate downstream gene expression in CAMERA 2 m.3-transfected cells. Such cells were then treated with a stimulator in accordance with the pathway of interest, as described in FIG. 16 and Table 10 (e.g., TNFα, forskolin, TGFβ, etc.). As expected, cells pathway-specific-CAMERA 2 m.3-transfected cells exhibited significant base editing at the CCR5 locus upon treatment with the pre-determined stimulus. By following multiple critical endogenous pathways, CAMERA enables construction of complex cell-state maps providing crucial insights into many biological processes. Indeed, stimulation with exogenous molecules in not essential for recording as CAMERA are able to sense and record endogenous fluctuations related to environmental and cell state changes. The promoter sequences listed in Table 10 comprise a mini-promoter at the end that has very low basal activity.

Tuning the Sensitivity of CAMERA 1.0

*E. coli* strain S1030 was co-transformed with a 10:10:1 mixture of plasmids R1:R2:W1.0.1. 24 colonies were selected to contain both the recording and writing plasmids and analyzed their R1:R2 ratios by high-throughput sequencing (HTS). Complete depletion of R1 was observed for 22 colonies, and the average R1 content was 4.9% (FIG. 6), suggesting that the recording system is so sensitive to the presence of the Cas9:sgRNA complex that the modest amount of leaky transcription from the uninduced TetO promoter resulted in enough Cas9:sgRNA to deplete R1 during colony formation.

To tune the sensitivity of the recording system, the RBS was swapped for the Cas9 gene from SD8 to the much weaker variants sd2 and sd2U, which are reported to have translation initiation strength of 1% and 0.02%, respectively, relative to SD8 (43), resulting in writing plasmids W1.0.2 and W1.0.3 (FIG. 6). *E. coli* strain S1030 was transformed with a 10:10:1 mixture of the recording plasmids R1:R2: W1.0.2 or W1.0.3, and 24 colonies which resulted from each transformation by HTS were analyzed. In bacteria containing writing plasmid W1.0.2, only 1 out of 24 colonies (4.2%) contained both R1 and R2, while 23 of 24 colonies had depleted R1 below detectable levels. Among colonies containing W1.0.3 with the weakest RBS mediating Cas9 translation, 5 out of 24 colonies (21%) contained both R1 and R2 (FIG. 6). The average R1 content did not exceed 10% in any transformation with W1.0.1, W1.0.2 or W1.0.3 (FIG. 6), indicating a strong trend of R1 depletion. To confirm that the observed R1 deletion was a result of the presence of the Cas9:sgRNA complex rather than plasmid transformation bias, control writing plasmid W1.0.1c was constructed by replacing the guide RNA spacer in W1.0.1 with an unrelated sequence so that the resulting sgRNA can no longer direct Cas9 to selectively cleave R1. E. coli strain S1030 was transformed with R1, R2, and W1.0.1c. Under these conditions, the coexistence of R1 and R2 was confirmed in 23 of 24 colonies (96%) with an average R1 content of 46% that is similar to the starting R1 content of 50% (FIG. 6), suggesting that the R1 depletion in bacteria containing writing plasmids was indeed a consequence of sgRNA-programmed targeting of R1 by Cas9.

To further increase the likelihood of harvesting colonies with the intact recording system that contains both R1 and R2, the input ratio of R1:R2 was adjusted from 1:1 to 5:1. It was hypothesized that by increasing the amount of substrate for the Cas9:sgRNA complex, the speed of R1 depletion could be slowed down, favoring the formation of colonies that contained both recording plasmids. Indeed, starting with a 5:1 R1:R2 ratio substantially increased the frequency of colonies that contained both R1 and R2 after transformation (FIG. 6). For cells transformed with a 10:2:1 mixture of R1:R2:W1.0.3, an average R1 content of 46% was observed and 19 out of 24 colonies (79%) were confirmed to contain both R1 and R2 (FIG. 6). The control transformation of 10:2:1 R1:R2:W1.0.1c again resulted in an R1 content similar to the R1:R2 input ratio (FIG. 6). Based on these results, writing plasmid W1.0.3 and recording plasmids R1 and R2 were chosen to assemble CAMERA 1.0.

Recording of Multiple Stimuli Using CAMERA 2.4

Minimal editing was observed in the absence of inducers, indicating that CAMERA 2.4 has a very low rate of background writing (FIG. 3F). The presence of aTc resulted in 7.7%, 0.69% and 0.55% editing at position 166, 186 and 195, corresponding to a 45-, 22- and 5-fold activation compared to the background editing, respectively (FIG. 3F). The addition of IPTG and aTc, however, boosted base editing at position 166 to 30%, 176-fold higher than the background editing at this position and 3.9-fold higher than the condition in which only aTc was provided (FIG. 3F). The presence of arabinose or rhamnose together with aTc initiated the recording driven by writing complexes 2 and 3 and resulted in 9.9% and 15.8% editing at position 186 and 195, respectively (FIG. 3F), representing a ≥330-fold and ≥ 144-fold increase over the background editing frequency at these two positions, and 14-fold and 29-fold higher base editing frequency than when the bacteria were treated with aTc only (FIG. 3F). When any two guide RNAs were transcribed together with BE2 from the presence of aTc plus any two of the three sgRNA inducers, significant base editing was observed at the two corresponding positions with minimal change (≤ 0.23%) at the third position, for which the inducer was absent (FIG. 3F), demonstrating that cross-talk between different writing complexes is minimal. Recording was initiated at all three target sites in the presence of all four small molecules (aTc, IPTG, arabinose, and rhamnose).

Recording Event Order Using CAMERA 2.5

E. coli S1030 carrying CAMERA 2.5 were tested for the recording outcome when stimuli were applied in different orders. Both the first and second treatments included three conditions: 1) no inducer, 2) arabinose, or 3) rhamnose, and the information recorded at position 129, 205-207 and 216 in CAMERA 2.5 was used to trace back to the presence of rhamnose and arabinose as well the order of the 2 events (FIG. 4A and FIG. 11). Base editing at position 205-207 in recording plasmid R5 recorded the presence of arabinose (FIG. 4B). When rhamnose was provided in either the first or the second treatment, more than 12% editing was observed at position 129, compared to ≤ 3.4% editing in bacteria that never encountered rhamnose (FIG. 11). However, only in cases where rhamnose was added following the arabinose treatment, significant editing of 6.5% was accumulated at position 216 (FIG. 11). In all six other cases lacking one inducer or treated with both inducers in the other order, ≤ 3.2% editing at position 216 was observed (FIG. 11). As sgRNA6 has two potential target sites in CAMERA 2.6, the total editing catalyzed by writing complex 2 is divided between positions 129 and 216 once G205-207 are modified. The editing ratio at position 216:129 in all 4 conditions in which bacteria were treated with rhamnose was quantified. The desired treatment order of arabinose followed by rhamnose resulted in an position 216:129 base editing ratio of 0.54, while this ratio was ≤ 0.09 in the absence of arabinose, or if the treatment order was reversed (FIG. 4C), suggesting that this base editing ratio serves as a reliable readout of event order in CAMERA 2.5.

Recording the Exposure to Light Using CAMERA 2.7 at the Single-Cell Level

The behavior of CAMERA 2.7 was characterized at the single-cell level (FIG. 13). With 15 randomly sorted individual cells, similar average light duration-dependent editing efficiencies were observed as from bulk cultures (FIG. 13). It was noticed that the editing variation between individual cells was smaller when only a small portion of the recording space was consumed (day 0 and 1, FIG. 13). However, significant editing polarization was observed as the recording process went on, likely because some cells were more active in base editing and in these cells the recording position was fully edited faster than in the rest of the cells (FIG. 13). Cells that lagged behind seemed to require a longer initiation period and the recording only started at later time points. By the end of day 3, all 15 characterized cells passed the initiation phase and exhibited different levels of editing (FIG. 13). In addition, editing in bulk cell cultures approached 100% after multiple days of culturing, suggesting that there are few unresponsive cells during the recording process.

Discussion

Synthetic memory devices were developed that record events of interest in live cells using two distinct CRISPR-mediated DNA modification mechanisms: Cas9 nuclease-catalyzed double-stranded DNA cleavage, and base editor-mediated C·G to T·A point mutation. Both CAMERA systems record the amplitude and duration of stimuli permanently in DNA of live cells. The analog nature of both recording systems allows the continuous monitoring of signals of interest and provides much more information compared to canonical digital memory devices.

In CAMERA 1 systems (Table 2), information is recorded in a form of plasmid R1:R2 ratio. Because R1 but not R2 expresses a functional fluorescent protein, information stored in CAMERA 1 systems can be read out transiently by monitoring post-recording cellular fluorescence in addition to the permanent readout by HTS. During the development of CAMERA 1, the RBS strength of Cas9 was decreased by four orders of magnitude to slow down the recording process to speeds convenient for study, indicating that these systems can respond quickly and are highly sensitive. This exceptional sensitivity may enable recording of very weak environmental signals that would otherwise be difficult to detect using other methods. In addition, two independent strategies were developed to reset CAMERA 1 systems that allow repeated cycles of erasing and rewriting using a single device.

CAMERA 2 systems (Table 2) translate stimuli of interest into single-nucleotide modifications. The devices can be multiplexed by stacking multiple responsive sgRNA units and it was demonstrated that four exogenous signals could be recorded using CAMERA 2.4 independently. Importantly, using a "ratcheted" overlapping protospacer design, CAMERA 2.5 can record events in an order-dependent manner, a capability that is difficult to envision using other synthetic memory devices. By including environment-responsive circuits, virus infection and light exposure have also been faithfully recorded using CAMERA 2.6 and 2.7. It was also demonstrated that CAMERA recording to high-copy plasmids maintains its reliability even in samples containing only 10-100 cells. The mammalian cell compatibility of base editing enables CAMERA 2m systems to function in human cells, including its use to record both exposure to external stimuli and flux through an endogenous signaling pathway. The development of additional inducible gene regulation circuits will enable CAMERA systems with even broader and more complex recording scopes.

Incorporating the recently developed ABE that mediates A·T to G·C base editing (23) could expand the versatility of CAMERA 2 systems by adding an additional dimension of recording that also can reverse directly the edits introduced by BE3. By using low-level writing, CAMERA systems might serve as molecular clocks to record cellular life span as well as signals of interest that persist for long periods of time. CRISPR technology has been applied in mammalian cells for molecular recording of exogenous signals and mapping cell linage using genomically integrated circuits (41, 42). CAMERA systems are not dependent on genomic integration of barcoded "scratchpads" that could result in undesired cellular perturbations. The use of base editors in CAMERA 2 systems minimizes stochastic indels and translocations that arise from double-stranded DNA breaks. These systems are envisioned being used for applications such as recording the presence of low-abundance extracellular and intracellular signals, mapping the linage of specific cell types, and constructing complex cell-state maps.

Materials and Methods
Cloning and Plasmids

Oligonucleotides were ordered from Integrated DNA Technologies. PCR fragments for plasmid construction were amplified using PhuU polymerase (ThermoFisher Scientific) and assembled by USER enzyme mix (New England Biolabs) according to the manufacturer's instructions. All DNA cloning was performed with NEB Turbo cells (New England Biolabs). Plasmids used in this work (see Table 3 for plasmid design specifics) are available from Addgene. Primers used for high-throughput sequencing are listed in Table 6.

Strains and Chemicals

All bacterial CAMERA devices developed in this work were tested with E. coli strain S1030 (44) with the exception of CAMERA 2.6, which was characterized in E. coli strain S2063. The complete genotypes of S1030 and S2063 are listed in Table 4. Unless otherwise noted, antibiotics were used at the following concentrations: carbenicillin (100 mg/ml), kanamycin (50 mg/ml), chloramphenicol (25 mg/ml), and spectinomycin (100 mg/ml). All chemicals were purchased from Sigma-Aldrich and Fisher Scientific.

In Vitro Cleavage of dsDNA by Cas9

SpCas9 protein was purified as previously described (45). Guide RNAs were transcribed using a T7 High Yield RNA Synthesis Kit (New England Biolabs) and purified with the E.Z.N.A. PF miRNA Isolation Kit (Omega Bio-tek, Inc.). The target dsDNA (full EGFP gene) was amplified by polymerase chain reaction using Q5 DNA polymerase (New England Biolabs) and purified by QIAquick PCR Purification Kit (Qiagen). For the cleavage reaction, 10 nM of the target DNA was incubated with 100 nM sgRNA in the presence of 100 nM Cas9 protein in a Cas9 DNA cleavage buffer (150 mM KCl, 10 mM MgCl2, 0.5 mM DTT, 0.1 mM EDTA, 20 mM HEPES pH 7.5). The reactions were incubated at 37° ° C. for 1 hour before being stopped with 6×DNA loading buffer and analyzed by non-denaturing agarose gel electrophoresis.

Stable Maintenance of R1 and R2 in E. coli S1030

E. coli S1030 were transformed with a mixture of 500 ng R1 and 500 ng R2 and plated on LB agar containing carbenicillin. A total of eight colonies were picked and grown to dense cultures in LB media. The R1/R2 ratio was analyzed by amplifying the EGFP gene from the cultures and sequencing using HTS. Two bacterial cultures with different R1 content (29% and 60%) were selected and validated for the recording plasmid maintenance. The starting bacterial culture was split into three cultures in parallel and diluted 1,000-fold into fresh LB media. The diluted cultures were grown at 37° C. with shaking for 16-24 hours to saturation before being diluted again. The dilution process (500- or 1,000-fold) was repeated until 56 generations of bacteria were produced. The EGFP fragment was amplified from the dense bacterial cultures after each round and analyzed for the R1 content using HTS.

Measuring the Growth Rates of Parental E. coli S1030 and E. coli S1030 Transformed with the Recording Plasmids Parental E. coli S1030 or E. coli S1030 containing the recording plasmid pair in different starting ratios were inoculated into LB or LB containing 100 µg/mL carbenicillin, respectively, and grew at 37° C., 220 rpm overnight. The dense cultures were inoculated at a ratio of 1:1,000 into 4 mL fresh LB with or without 100 g/mL carbenicillin in a 24-deep-well plate. Three individual cultures were prepared for each growth condition and allowed to grow at 37° C., 220 rpm. At designed time points, 200 µL of the bacterial cultures were transferred from the 24-deep-well plate into a 96-well assay plate with clear bottom and the absorbance at 600 nm was measured using a TECAN Infinite M1000 Pro plate reader.

Setting Up CAMERA 1.0 in E. coli S1030

For the initial validation of CAMERA 1.0, E. coli S1030 were transformed with a mixture of 500 ng R1, 500 ng R2 and 100 ng W1.0.1, W1.0.2, W1.0.3, or W1.0.1c. The transformed bacteria were plated on LB agar containing carbenicillin and spectinomycin. A total of 24 colonies were picked and grown to dense cultures. The R1/R2 ratio was analyzed by amplifying the EGFP gene from the cultures and sequencing using HTS. To help maintaining R1 during colony formation, E. coli S1030 were transformed with a mixture of 800 ng R1, 200 ng R2 and 100 ng W1.0.1, W1.0.2, W1.0.3, or W1.0.1c. A total of 24 colonies formed on LB agar containing carbenicillin and spectinomycin were picked, grown in LB and analyzed for their R1/R2 ratios.

The E. coli culture carrying CAMERA 1.0 with 42% R1 and 58% R2 was split into three cultures and inoculated in a 1:500 ratio (v/v) into fresh LB media containing 200 ng/mL aTc and grown at 37° ° C. with shaking. The bacteria were harvested 3 hours and 6 hours after inoculation and the R1/R2 ratio was analyzed by amplifying the EGFP fragment and sequencing using HTS.

Characterization of CAMERA 1.1 in *E. coli* S1030

*E. coli* S1030 were transformed with a mixture of 500 ng R1, 500 ng R2 and 100 ng W1.1 and plated on LB agar containing carbenicillin and spectinomycin. A total of eight colonies were picked, grown to dense cultures and analyzed for their R1 content. The bacterial culture carrying CAMERA 1.1 with 23% R1 and 77% R2 was selected for further test and split into three individual cultures. The bacterial cultures were inoculated 1:500 (v/v) into fresh LB media containing 1) no inducer, 2) 100 ng/ml aTc, 3) 500 µM IPTG, and 4) 100 ng/ml aTc and 500 µM IPTG. The treated bacteria were allowed to grow at 37° C. with shaking for 3 hours and the R1/R2 ratio was analyzed by amplifying the EGFP fragment and sequencing using HTS.

To characterize the analog behavior of CAMERA 1.1, the starting cultures were inoculated 1:100 (v/v) into fresh LB media containing 0, 2, 5, 10, 20, 30, 40, 60, 80, 100, or 150 µM IPTG in the presence of 50 ng/mL aTc. The treated bacteria were allowed to grow at 37° C. with shaking for 4 hours and the inducers were removed by diluting the culture in a 1:250 ratio with fresh LB and culturing overnight. The resulting R1/R2 ratio in the bacterial culture was analyzed by amplifying the EGFP gene and sequencing in a high throughput manner. To induce the EGFP expression as a transient readout, the bacterial culture was diluted again in a 1:125 ratio with fresh LB containing 0.25 mM arabinose. EGFP fluorescence was measured after 4 hours of induction using a TECAN Infinite M1000 Pro plate reader with excitation/emission wavelength set to 485/530 nm.

Recording and Erasing of CAMERA 1.2

*E. coli* S1030 were transformed with 500 ng of R3 and 500 ng of R4. The transformed bacteria were plated on LB agar containing 50 µg/mL kanamycin and 25 µg/mL chloramphenicol to select for the presence of both plasmids. A total of eight colonies were picked, grown in fresh LB and analyzed for their R3 content. The bacteria containing 38% R3 and 62% R4 were selected to test whether antibiotic treatment could promote the R3:R4 ratio shift. The selected bacterial culture was split into two individual cultures and diluted 1:30 into fresh LB media containing 0.4, 0.8, 1.2, or 1.6 mg/mL kanamycin or 100 µg/mL chloramphenicol. The process was repeated one more time before the resulting bacteria were analyzed for their R3 content.

To perform recording and device resetting using CAMERA 1.2, *E. coli* S1030 were transformed with 500 ng R3, 250 ng R4 and 100 ng W1.1 and plated on LB agar containing 25 µg/mL kanamycin, 10 µg/mL chloramphenicol and 100 µg/mL spectinomycin. A bacterial colony carrying CAMERA 1.2 with 36% of R3 and 64% of R4 was selected for further characterization and split into three independent cultures. To initiate the recording process, the bacterial culture was inoculated 1:30 into fresh LB media containing 50 ng/ml aTc and 100 µM IPTG, whereas to reset the device, a similar inoculation protocol was performed with fresh LB media containing 0.8 mg/mL kanamycin. The inoculated culture was allowed to grow at 37° C. with shaking for 12-24 hours to saturation. The process was repeated until a desired R3:R4 ratio was obtained. The R3 content was characterized by HTS analysis of the EGFP fragment amplified from the bacterial culture.

Recording and Device Resetting Using CAMERA 1.3

*E. coli* S1030 were transformed with 210 ng R3, 70 ng R4 and 40 ng W1.2 and plated on LB agar containing 10 µg/mL kanamycin, 5 µg/mL chloramphenicol and 100 µg/mL spectinomycin. Two bacterial colonies carrying CAMERA 1.3 containing 36% and 77% R3 were selected and grown into three independent cultures for the recording and resetting tests. The bacterial cultures were inoculated 1:1,000 into fresh LB media containing 100 ng/ml aTc and 100 µM IPTG or 100 ng/mL aTc and 5 mM rhamnose for recording or resetting purposes. The process was repeated once if the desired R3:R4 ratio was not reached. To titrate the recording and resetting speed, the *E. coli* S1030 cultures carrying CAMERA 1.3 with 36% R3 were diluted in a 1:1,000 ratio in fresh LB media and treated by 100 ng/mL aTc and 0.2, 0.5, 1, or 5 mM rhamnose. The bacteria were allowed to grown into dense cultures at 37° ° C. with shaking for 24 hours. Once the recording process was finished, the resulting cultures were diluted again and treated with 100 ng/ml aTc and 0.1, 0.25, 0.5, or 2.5 mM IPTG. The bacteria were grown at 37° C. with shaking for 24 hours to bring back the consumed R3. The R3:R4 ratio was characterized by high throughput sequencing analysis of the EGFP fragment amplified from the bacterial culture.

Characterization of CAMERAs 2.0 and 2.1 in *E. coli* S1030

*E. coli* S1030 were transformed with R1 and W2.0 and plated on LB agar containing carbenicillin and spectinomycin. A single colony was picked and cultured at 37° C. with shaking to obtain a dense culture as the starting material of the recording experiments. The split bacterial cultures were diluted 500- or 1,000-fold into fresh LB media containing 0, 2, 20, or 200 ng/mL aTc and grown in a 96-deep-well plate at 37° C. with shaking for 16-24 hours before being diluted again. The process was repeated until 68 generations of bacteria were produced. Editing promoted by the BE2: sgRNAa complex was characterized by amplifying the EGFP gene from the bacterial culture and analyzing the amplicon using HTS.

*E. coli* S1030 carrying CAMERA 2.1 were treated with 1) no inducer, 2) 1 mM IPTG, 3) 200 ng/mL aTc and 1, 0.1, or 0.01 mM IPTG. Similar culturing and characterizing protocol was adapted as that was used for CAMERA 2.0.

To confirm that CAMERA 2.0 could record the present duration of a stimulus, *E. coli* S1030 cultures carrying CAMERA 2.0 were diluted 1,000-fold into fresh LB media and treated with or without 100 ng/mL aTc. The bacteria were grown in a 24-deep-well plate at 37° C. with shaking for 12 hours and diluted 1,000-fold again into fresh LB containing the same concentrations of aTc. In the 3rd dilution, bacteria that had not encountered the inducer were split into fresh LB media with or without 100 ng/mL aTc. The process was repeated once in the 4th dilution. Similarly, bacteria that had been treated with aTc were split and treated with or without aTc from generation 20 to 40. *E. coli* S1030 carrying CAMERA 2.1 were tested for IPTG sensing using a similar set up.

Characterization of CAMERA 2.2 and 2.3 in *E. coli* S1030

*E. coli* S1030 carrying CAMERA 2.2 were diluted 500-fold (v/v) into fresh LB media containing 1) no inducer, 2) 100 ng/ml aTc, 3) 0.1 mM arabinose, and 4) 100 ng/ml aTc and 0.1 mM arabinose in a 96-deep-well plate and grown at 37° C. with shaking for 24 hours before being stopped and characterized for base editing at position 186 of the EGFP gene.

*E. coli* S1030 carrying CAMERA 2.3 were diluted 500-fold (v/v) into fresh LB media containing 1) no inducer, 2) 50 ng/ml aTc, 3) 1 mM rhamnose, and 4) 50 ng/ml aTc and 1 mM rhamnose in a 96-deep-well plate and grown at 37° C. with shaking for 24 hours before being stopped and characterized for base editing. The rhamnose concentration was varied from 25 µM to 5 mM in the presence of 50 ng/ml aTc to test the capability of CAMERA 2.3 to record the intensity of the stimulus.

Recording Multiple Independent Signals Using CAMERA 2.4

E. coli S1030 carrying CAMERA 2.4 (recording plasmid R1 and writing plasmids W2.4-1 and W2.4-2) were prepared to record four small molecule signals, including aTc (100 ng/ml), IPTG (100 µM), arabinose (100 µM) and rhamnose (1 mM). The bacterial culture was diluted 1:500 by fresh LB media in a 96-deep-well plate and treated with different combinations of inducers and grown at 37° ° C. with shaking. The bacteria were harvested 24 hours after inoculation and base editing at positions 166, 186, and 195 of the EGFP gene was characterized by HTS.

Stimulus Order-Dependent Recording Using CAMERA 2.5

To characterize CAMERA 2.5, E. coli S1030 were transformed with W2.5-1, W2.5-2 and R5 and plated on LB agar containing carbenicillin, spectinomycin and chloramphenicol. A single colony was picked and grown at 37° ° C. with shaking for 24 hours to obtain a dense culture. The resulting bacteria culture carrying CAMERA 2.5 was split into three independent cultures and inoculated 1:500 into fresh LB media containing 1) no inducer, 2) 100 ng/mL aTc and 100 µM arabinose, or 3) 100 ng/mL aTc and 5 mM rhamnose in a 96-deep-well plate and grown at 37° C. with shaking for 24 hours. The treatment involving 100 ng/ml aTc and 100 µM arabinose was repeated for the following 5 days to allow the editing at positions 205-207 to accumulate. By the end of day 6, the cultures were split and inoculated 1:500 into fresh LB media containing 1) no inducer, or 2) 100 ng/mL aTc and 5 mM rhamnose and grown at 37° C. with shaking for 24 hours. The cultures that had not been treated with any inducers in day 1 were split and inoculated 1:500 into fresh LB media containing 1) no inducer, or 2) 100 ng/mL aTc and 100 µM arabinose. The same inoculation procedure was performed for bacteria that were treated with 100 ng/ml aTc and 5 mM rhamnose in day 1. The same conditions were applied for five more days in a row before all bacteria were harvested for characterization. Editing at positions 129, 205-207, and 216 of the EGFP gene was analyzed by HTS.

Recording Phage Infection Using CAMERA 2.6 in E. coli S2063

E. coli S2063 were transformed with R1 and W2.6 and plated on LB agar containing carbenicillin and spectinomycin. A single colony was picked and cultured at 37° C. with shaking and split into three independent cultures as the starting materials of the recording experiments. Phage solution (SP54, wild type phage that carries PspB/C) was prepared with a titer of 1010. S2063 carrying CAMERA 2.6 were diluted 1:500 into fresh LB media in 96-deep-well plates and grown at 37° ° C. with shaking for approximately 4 hours to reach the exponential phase of growth (OD 600 nm=0.5-0.8). The bacteria were then 1:4 (v/v) treated with LB or phage solution. A total of 4 µL treated or LB diluted bacterial culture was inoculated into 0.5 mL fresh LB media in 96-deep-well plates and allowed to grow at 37° C. with shaking for additional 24 hours. Editing at position 166 of the EGFP gene was quantified by HTS.

Recording Exposure to Light Using CAMERA 2.7

E. coli S1030 were transformed with R6, W2.7-1, and W2.7-2 and plated on LB agar containing carbenicillin, spectinomycin and kanamycin. A single colony was picked and cultured at 37° C. with shaking and the dense culture was split into three parallel samples to serve as the starting materials of the recording experiments. The bacteria were diluted 1,000-fold into fresh LB media in 24-deep-well plates and grown at 37° C. with shaking. The bacteria were grown either in darkness (wrapped in aluminum foil) or under white light (the built-in fluorescent lamp in the shaker incubator) for 24 hours before being stopped and analyzed for base editing at position 166 of the EGFP gene using HTS.

Recording Exposure to Light Using CAMERA 2.7 at the Single Cell Level

E. coli S1030 transformed with R6, W2.7-1, and W2.7-2 (described above) were cultured in darkness at 37° ° C. with shaking and a saturated culture was used as the starting point for the recording experiment. The culture was diluted 1,000-fold into fresh LB media containing 100 µg/mL carbenicillin, 100 µg/mL spectinomycin and 50 µg/mL kanamycin in a 24-deep-well plate and grown under white light at 37° C., 220 rpm. The bacterial culture was diluted 1,000-fold again into fresh LB after 24 hours and continued to grow under white light. The process was repeated for three consecutive days.

At the end of each day, a 50-µL aliquot from the culture was removed the shaker, diluted with PBS, and stained with SYTO 17 Red Fluorescent Nucleic Acid Stain (ThermoFisher Scientific) and READIDROP™ Propidium Iodide (Bio-Rad) and sorted using a Beckman Coulter MoFlo Legacy Cell Sorter into 96-well PCR plates, in which 10 µL of water was preloaded to harvest live single cell, 10-cell, or 100-cell samples.

96-well plates containing sorted bacteria were heated up to 95° C. for 5 minutes and removed to room temperature, followed by freezing at −80° C. for at least 30 minutes. Samples were then moved to room temperature and allowed to thaw slowly. The heat-freeze-thaw procedure was repeated once to maximize bacterial lysis.

iTaq™ Universal SYBR® Green Supermix (Bio-Rad) and primers were loaded into the lysed bacterial solution and the polymerase chain reaction was monitored by a qPCR machine (Bio-Rad). A total of 45 cycles of polymerase chain reactions (95° C. 15 seconds, 60° C. 30 seconds and 68° C. 20 seconds) were performed and samples containing 100, 10, and 1 bacteria resulted in Ct values of ~29, ~34, and ~39, respectively. The illumine adapters were added by diluting the 1st PCR reactions and performing additional 7 cycles of PCR. The illumine barcodes were added using a similar procedure by diluting the 2nd PCR reactions and performing additional 7 cycles of PCR. The resulted PCR products were combined and the library was analyzed for base editing at position 166 of the EGFP gene using HTS.

Recording in the Genomic Safe Harbor Gene CCR5 in Human Cells

HEK293T cells (GenTarget Inc.) were cultured in 48-well plates (collagen-coated, ~40,000 cells seeded per well) in DMEM plus GlutaMAX (Life Technologies) with 10% FBS. Transfection was performed 24 hours after plating when cells reached 60-70% confluence. To initiate recording in the human safe harbor gene CCR5, 800 ng of BE3 plasmid and 40 ng of guide RNA plasmid (CAMERA 2 m.0, the guide RNA sequences are listed in Table 5) were transfected in each well using 1.2 µl Lipofectamine 2000 (Life Technologies) following the manufacturer's protocol. To multiplex recording using multiple guide RNAs, each guide RNA plasmid was applied at a dose of 40 ng together with 800 ng of BE3 plasmid. The transfected cells were incubated for additional 3 days before being harvested for genomic DNA extraction. Base editing was quantified by amplifying the CCR5 gene fragment from genomic DNA by PCR and analyzing by HTS.

Recording the Presence of Doxycycline as Single-Nucleotide Changes in CCR5 in Human Cells To test whether CAMERA 2 systems can record the presence of exogenous small molecules in the form of base editing, a doxycycline-inducible promoter was installed in front of BE3 to generate CAMERA 2 m.1 (pTRE3G-BE3). HEK293T cells were transfected with 400 ng pTRE3G-BE3, 20 ng of guide RNA plasmid, and 100 ng of pCMV-Tet3G (Clontech Laboratories, Inc.) using 1 µl Lipofectamine 2000. A stock solution of 1 mg/mL doxycycline was prepared in ddH2O and added to the media 6 hours after transfection. The transfected cells were incubated for additional 3 days before being harvested for genomic DNA extraction. Base editing was quantified by amplifying the CCR5 gene fragment from genomic DNA by PCR and analyzing by HTS.

Recording the Presence of Doxycycline and IPTG Using Multiple Responsive sgRNA Expression Units in HEK293T Cells To record the presence of multiple exogenous small molecules in the form of base editing, a LacI-suppressed U6 promoter for sgRNA A (U6LacI-sgRNA A) and a TetR-suppressed H1 promoter for sgRNA B (H1TetR-sgRNA B) (46) were installed. TetR and LacI fused with nucleus localization sequences were placed downstream the human UBC promoter (UBC-TetR-P2A-LacI) in an accessary plasmid. Combined with the pCMV-BE3 plasmid, these components constitute CAMERA 2 m.2 to record the presence of doxycycline and IPTG in human cells.

HEK293T cells were cultured in 96-well plates (collagen-coated, ~20,000 cells seeded per well) in DMEM plus GlutaMAX (Life Technologies) with 10% FBS. Transfection was performed 24 hours after plating when cells reached 60-70% confluence. CAMERA 2 m.2 were prepared in 5 µL of reduced serum media (Opti-MEM, Life Technologies) with 200 ng of BE3 plasmid, 100 ng of UBC-TetR-P2A-LacI plasmid, 20 ng of U6LacI-sgRNA A plasmid, and 20 ng of H1TetR-sgRNA B plasmid and transfected using 0.5 µl Lipofectamine 2000. Stock solutions of 1 M IPTG and 1 mg/mL doxycycline were prepared in ddH2O and added to the media 6 hours after transfection. The transfected cells were incubated for additional 3 days before being harvested for genomic DNA extraction and HTS analysis.

Recording Wnt Signaling in the CCR5 Loci of Human Cells

To enable CAMERA 2m to record Wnt signaling, a (TCF/LEF)7 promoter was installed upstream BE3 and BE3-P2A-Luc to generate CAMERA 2 m.3 ((TCF/LEF)7-BE3 and ((TCF/LEF)7-BE3-P2A-Luc). TOPFlash ((TCF/LEF)7-Luc) (47) was used as a transient readout of Wnt signaling. A control plasmid that encodes the *Renilla* luciferase was included to normalize transfection efficiency for luminescence readout.

HEK293T cells were cultured in 96-well plates (collagen-coated, ~20,000 cells seeded per well) in DMEM plus GlutaMAX (Life Technologies) with 10% FBS. Transfection was performed 24 hours after plating when cells reached 60-70% confluence. CAMERA 2 m.3 were prepared in 5 µL of reduced serum media (Opti-MEM, Life Technologies) with 200 ng of ((TCF/LEF)7-BE3 or ((TCF/LEF)7-BE3-P2A-Luc plasmids, 20 ng of U6-sgRNA A plasmid and 10 ng of *Renilla* luciferase plasmid and transfected using 0.5 µl Lipofectamine 2000. TOP-Flash plasmid (200 ng) was transfected using a similar setup without including the guide RNA plasmid. A stock solution of 1 M LiCl was prepared in ddH2O and added to the media to a final concentration of 50 mM 10 hours after transfection.

Firefly luciferase and *Renilla* luciferase activities were measured 24 hours after LiCl treatment. Luciferase substrates were purchased from Promega. To characterize Wnt-stimulated base editing, the transfected cells were incubated for 3 days before being harvested for genomic DNA extraction. Base editing was quantified by amplifying the CCR5 gene fragment from genomic DNA by PCR and analyzing by HTS.

Recording Signaling of Additional Pathways in the CCR5 Loci of Human Cells

To enable CAMERA 2m to record signaling in additional pathways, the promoters listed in Table 10 were installed upstream BE3 and BE3-P2A-Luc to generate a new CAMERA 2m construct HEK293T cells were cultured in 96-well plates (collagen-coated, ~20,000 cells seeded per well) in DMEM plus GlutaMAX (Life Technologies) with 10% FBS. Transfection was performed 24 hours after plating when cells reached 60-70% confluence. The CAMERA 2m plasmids were prepared in 5 µL of reduced serum media (Opti-MEM, Life Technologies). The triggering molecules identified in Table 10 were added to the cells at the specified concentrations.

Figure 16:
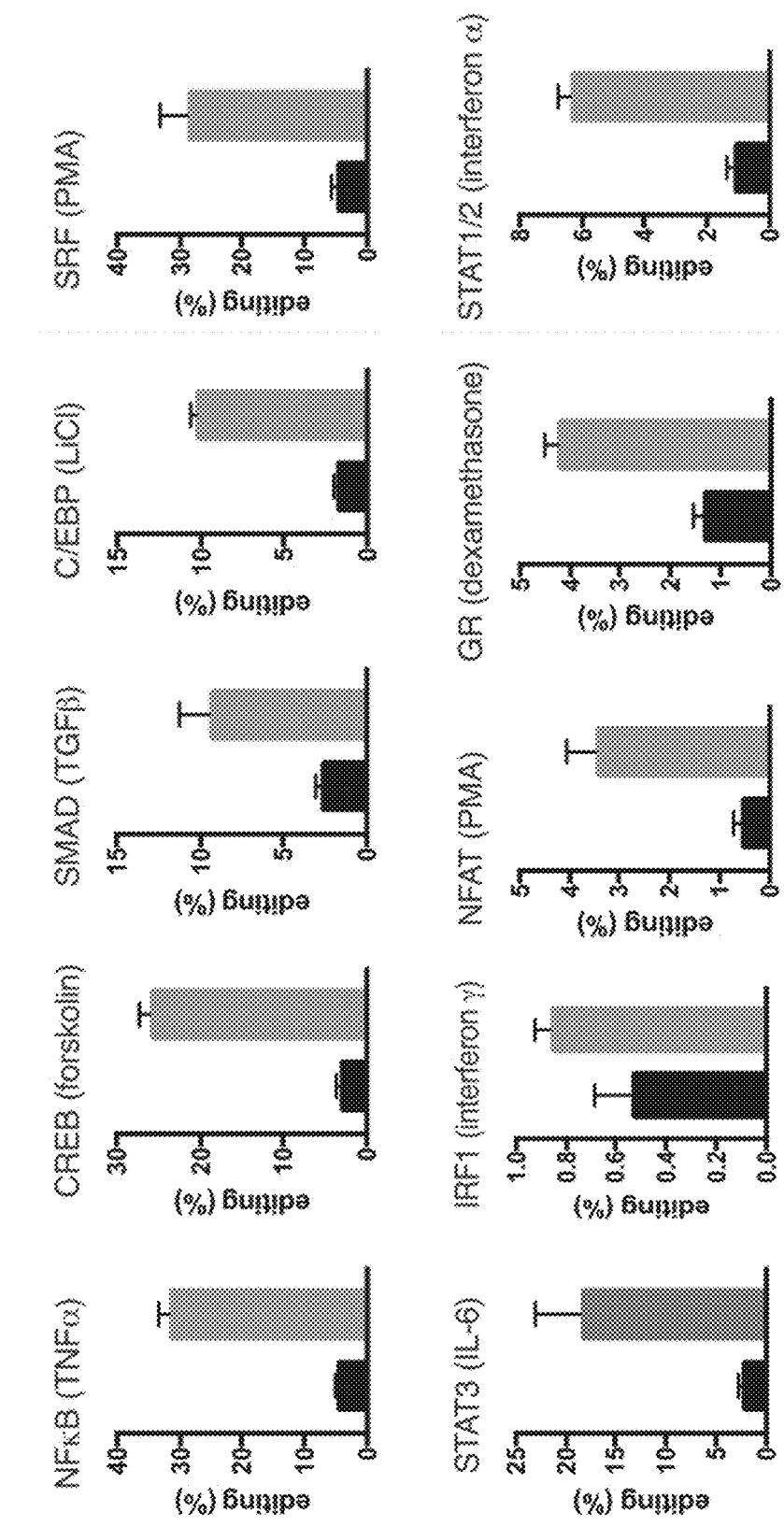
FIG. 16 depicts the raw base editing efficiencies for CAMERA 2 in mammalian cells targeting the human safe harbor gene CCR5. The recorded pathway and the inducing signal used in each experiment are indicated above each panel. Black bars represent the percent base editing in unstimulated cells, while the gray bars represent the percent base editing in the presence of the indicated stimulus.
Figure 16:
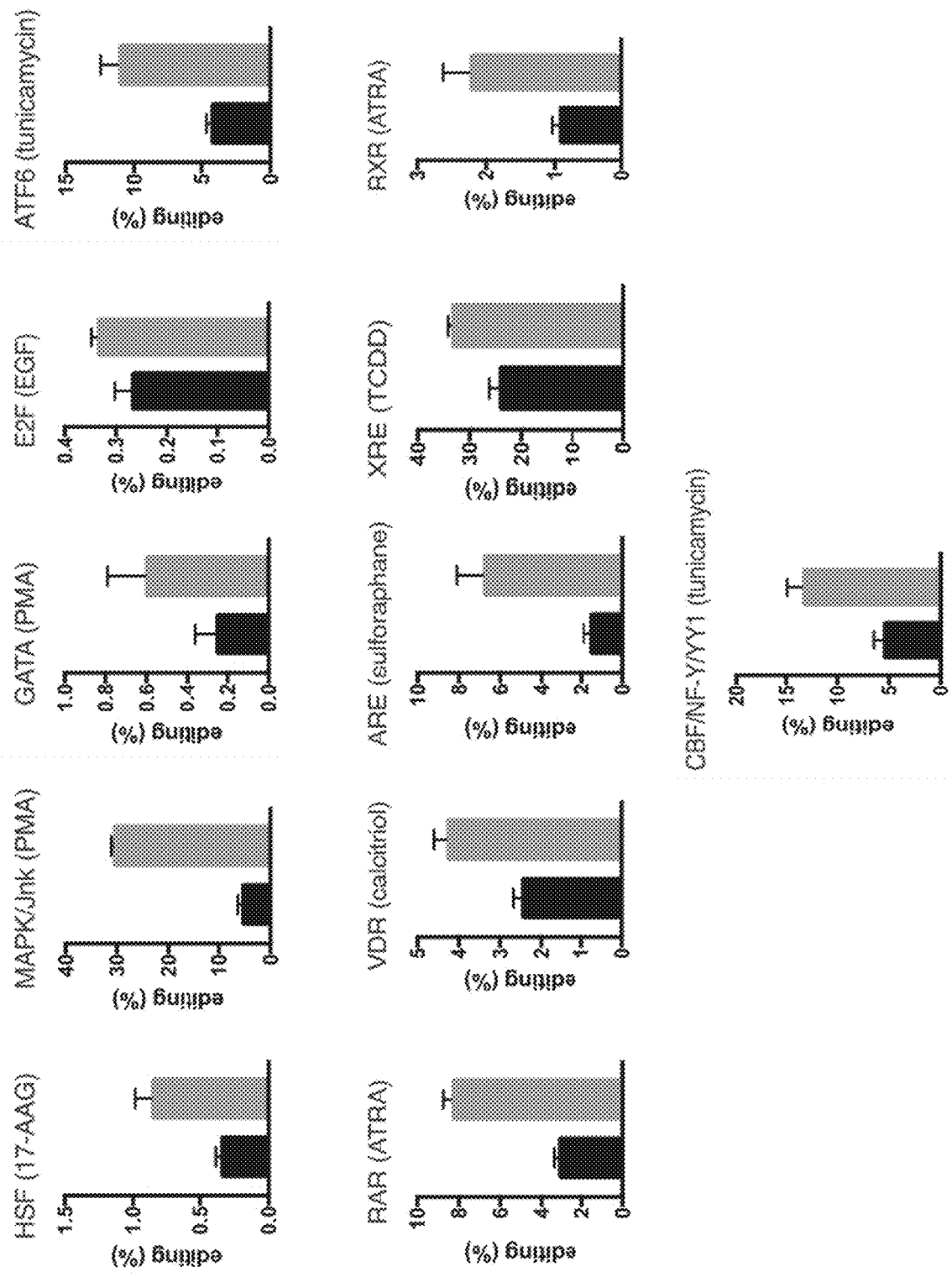

To characterize pathway-stimulated base editing, the transfected cells were incubated for 2-3 days before being harvested for genomic DNA extraction. Base editing was quantified by amplifying the CCR5 gene fragment from genomic DNA by PCR and analyzing by HTS. As seen in FIG. 16, increases in CCR5 editing by the CAMERA 2m system was induced by the presence of each of the triggering molecules.

The following are some specific numbered embodiments of the invention disclosed herein. These embodiments are exemplary and for the purpose of illustration only. It will be understood that the invention is not limited to the embodiments, but embraces all such forms and combinations thereof as come within the scope of the above disclosure.

Embodiment 1. A writing plasmid comprising:
  (i) a nucleic acid sequence encoding a nucleic acid programmable DNA binding protein (napDNAbp) operably linked to a first promoter;
  (ii) a nucleic acid sequence encoding a single guide RNA (sgRNA) operably linked to a second promoter, wherein the sgRNA is complementary to a target sequence; and
  (iii) an origin of replication;
    wherein at least one of the promoters is an inducible promoter, and wherein the sgRNA associates with the napDNAbp under conditions that induce expression of the sgRNA and expression of the napDNAbp.

Embodiment 2. The writing plasmid of embodiment 1, wherein the first promoter and the second promoter are different promoters.

Embodiment 3. The writing plasmid of embodiment 1 or 2, wherein the first promoter is a constitutive promoter.

Embodiment 4. The writing plasmid of embodiment 3, wherein the constitutive promoter is a constitutive Lac promoter.

Embodiment 5. The writing plasmid of any one of embodiments 1-4, wherein the first promoter is an inducible promoter.

Embodiment 6. The writing plasmid of embodiment 5, wherein the inducible promoter is an anhydrotetracycline-inducible promoter, IPTG-inducible promoter, rhamnose-inducible promoter, or arabinose-inducible promoter.

Embodiment 7. The writing plasmid of embodiment 1, wherein the napDNAbp is a Cas9 domain, a Cpf1 domain, a CasX domain, a CasY domain, a C2c1 domain, a C2c2 domain, or a C2c3 domain.

Embodiment 8. The writing plasmid of embodiment 7, wherein the Cas9 domain is a nuclease inactive Cas9 (dCas9) domain, a Cas9 nickase (Cas9n) domain, or a nuclease active Cas9 domain.

Embodiment 9. The writing plasmid of embodiment 8, wherein the Cas9 domain is a Cas9 domain from *Streptococcus pyogenes* (spCas9).

Embodiment 10. The writing plasmid of any one of embodiments 7-9, wherein the Cas9 domain comprises an amino acid sequence that is at least 90% identical to the amino acid sequence provided in any one of SEQ ID NOs: 10-260.

Embodiment 11. The writing plasmid of any one of embodiments 7-9, wherein the Cas9 domain comprises the amino acid sequence of any one of SEQ ID NOs: 10-260.

Embodiment 12. The writing plasmid of embodiment 1 or 2, wherein the second promoter is a constitutive promoter.

Embodiment 13. The writing plasmid of embodiment 12, wherein the constitutive promoter is a constitutive Lac promoter.

Embodiment 14. The writing plasmid of embodiment 1 comprising: (i) a nucleic acid sequence encoding a napDNAbp operably linked to an inducible promoter, (ii) a nucleic acid sequence encoding a sgRNA operably linked to a constitutive promoter, wherein the sgRNA is complementary to a target sequence, and (iii) an origin of replication, wherein the sgRNA is constitutively expressed, and wherein the sgRNA associates with the napDNAbp under conditions that induce the expression of the napDNAbp.

Embodiment 15. The writing plasmid of embodiment 14, wherein the inducible promoter is an anhydrotetracycline-inducible promoter, and wherein the constitutive promoter is a constitutive Lac promoter.

Embodiment 16. The writing plasmid of embodiment 1 or 2, wherein the second promoter is an inducible promoter.

Embodiment 17. The writing plasmid of embodiment 16, wherein the inducible promoter is an IPTG-inducible promoter, anhydrotetracycline-inducible promoter, rhamnose-inducible promoter, or arabinose-inducible promoter.

Embodiment 18. The writing plasmid of embodiment 1 comprising: (i) a nucleic acid sequence encoding a Cas9 domain operably linked to a constitutive promoter, (ii) a nucleic acid sequence encoding a sgRNA operably linked to an inducible promoter, wherein the sgRNA is complementary to a target sequence, and (iii) an origin of replication, wherein the Cas9 domain is constitutively expressed, and wherein the sgRNA associates with the Cas9 domain under conditions that induce the expression of the sgRNA.

Embodiment 19. The writing plasmid of embodiment 1 comprising: (i) a nucleic acid sequence encoding a napDNAbp operably linked to a first inducible promoter, (ii) a nucleic acid sequence encoding a sgRNA operably linked to a second inducible promoter, wherein the sgRNA is complementary to a target sequence, and (iii) an origin of replication, wherein the sgRNA associates with the napDNAbp under conditions that induce expression of the napDNAbp and expression of the sgRNA.

Embodiment 20. The writing plasmid of embodiment 19, wherein the first inducible promoter is an anhydrotetracycline-inducible promoter, and wherein the second inducible promoter is an IPTG-inducible promoter.

Embodiment 21. The writing plasmid of any one of embodiments 1-20, wherein the writing plasmid further comprises (iv) a nucleic acid sequence encoding a second sgRNA operably linked to a third promoter, wherein the second sgRNA is complementary to a target sequence, and wherein the second sgRNA associates with the napDNAbp under conditions that induce the expression of the napDNAbp and expression of the second sgRNA.

Embodiment 22. The writing plasmid of embodiment 21, wherein the first promoter, the second promoter, and the third promoter are different promoters.

Embodiment 23. The writing plasmid of embodiment 21 or 22, wherein the third promoter is a constitutive promoter.

Embodiment 24. The writing plasmid of embodiment 23, wherein the constitutive promoter is a constitutive Lac promoter.

Embodiment 25. The writing plasmid of embodiment 21 or 22, wherein the third promoter is an inducible promoter.

Embodiment 26. The writing plasmid of embodiment 25, wherein the inducible promoter is a rhamnose-inducible promoter, IPTG-inducible promoter, anhydrotetracycline-inducible promoter, or arabinose-inducible promoter.

Embodiment 27. The writing plasmid of embodiment 1 comprising: (i) a nucleic acid sequence encoding a napDNAbp operably linked to a first inducible promoter, (ii) a nucleic acid sequence encoding a first sgRNA operably linked to a second inducible promoter, wherein the first sgRNA is complementary to a target sequence, (iii) a nucleic acid sequence encoding a second sgRNA operably linked to a third inducible promoter, wherein the second sgRNA is complementary to a target sequence, and (iv) an origin of replication,
  wherein the first sgRNA associates with the napDNAbp only under conditions that induce expression of the napDNAbp and expression of the first sgRNA, and wherein the second sgRNA associates with the napDNAbp only under conditions that induce expression of the napDNAbp and expression of the second sgRNA.

Embodiment 28. The writing plasmid of embodiment 27, wherein the first inducible promoter is an anhydrotetracycline-inducible promoter, the second inducible promoter is an IPTG-inducible promoter, and the third inducible promoter is a rhamnose-inducible promoter.

Embodiment 29. The writing plasmid of any one of embodiments 1-28 for use in a bacterial cell.

Embodiment 30. The writing plasmid of any one of embodiments 1-29, wherein the origin of replication is suitable for use in a bacterial system.

Embodiment 31. The writing plasmid of embodiment 30, wherein the origin of replication comprises a pSC101, pMB1, pBR322, ColE1, or p15A origin of replication sequence.

Embodiment 32. A bacterial cell comprising the writing plasmid of any one of embodiments 1-31.

Embodiment 33. A writing plasmid for use in a prokaryotic cell comprising:
  (i) a nucleic acid sequence encoding a fusion protein comprising a nucleic acid programmable DNA binding protein (napDNAbp) and a nucleic acid editing domain operably linked to a first promoter;
  (ii) a nucleic acid sequence encoding a sgRNA operably linked to a second promoter, wherein the sgRNA is complementary to a target sequence; and
  (iii) an origin of replication,
    wherein at least one of the promoters is an inducible promoter, and wherein the sgRNA associates with the napDNAbp under conditions that induce the expression of the fusion protein and expression of the sgRNA.

Embodiment 34. The writing plasmid of embodiment 33, wherein the first promoter and the second promoter are different promoters.

Embodiment 35. The writing plasmid of embodiment 33 or 34, wherein the first promoter is a constitutive promoter.

Embodiment 36. The writing plasmid of embodiment 35, wherein the constitutive promoter is a constitutive Lac promoter.

Embodiment 37. The writing plasmid of embodiment 33 or 34, wherein the first promoter is an inducible promoter.

Embodiment 38. The writing plasmid of embodiment 37, wherein the inducible promoter is an anhydrotetracycline-inducible promoter, IPTG-inducible promoter, rhamnose-inducible promoter, or arabinose-inducible promoter.

Embodiment 39. The writing plasmid of embodiment 33, wherein the target nucleic acid sequence is present in a reporter gene.

Embodiment 40. The writing plasmid of embodiment 39, wherein the reporter gene encodes a fluorescent protein.

Embodiment 41. The writing plasmid of embodiment 40, wherein the fluorescent protein is an EGFP protein, or variant or fragment thereof.

Embodiment 42. The writing plasmid of embodiment 41, wherein the EGFP protein is a full-length EGFP protein.

Embodiment 43. The writing plasmid of embodiment 41, wherein the EGFP protein is a EGFP protein fragment.

Embodiment 44. The writing plasmid of embodiment 33 or 34, wherein the second promoter is a constitutive promoter.

Embodiment 45. The writing plasmid of embodiment 44, wherein the constitutive promoter is a constitutive Lac promoter.

Embodiment 46. The writing plasmid of embodiment 33 comprising: (i) a nucleic acid sequence encoding a fusion protein comprising a napDNAbp and a nucleic acid editing domain operably linked to an inducible promoter, (ii) a nucleic acid sequence encoding a sgRNA operably linked to a constitutive promoter, wherein the sgRNA is complementary to a target sequence, and (iii) an origin of replication,
    wherein the sgRNA is constitutively expressed, and wherein the sgRNA associates with the napDNAbp under conditions that induce the expression of the fusion protein.

Embodiment 47. The writing plasmid of embodiment 46, wherein the inducible promoter is an anhydrotetracycline-inducible promoter, and wherein the constitutive promoter is a constitutive Lac promoter.

Embodiment 48. The writing plasmid of embodiment 33 or 34, wherein the second promoter is an inducible promoter.

Embodiment 49. The writing plasmid of embodiment 48, wherein the second inducible promoter is an anhydrotetracycline-inducible promoter, an IPTG-inducible promoter, an arabinose-inducible promoter, a rhamnose-inducible promoter, a phage shock promoter (PSP), a light-inducible promoter, or a heat-inducible promoter.

Embodiment 50. The writing plasmid of embodiment 33 comprising: (i) a nucleic acid sequence encoding a fusion protein comprising a napDNAbp and a nucleic acid editing domain operably linked to a first inducible promoter, (ii) a nucleic acid sequence encoding a sgRNA operably linked to a second inducible promoter, wherein the sgRNA is complementary to a target sequence, and (iii) an origin of replication,
    wherein the sgRNA associates with the napDNAbp only under conditions that induce the expression of the fusion protein and expression of the sgRNA.

Embodiment 51. The writing plasmid of embodiment 50, wherein the first inducible promoter is an anhydrotetracycline-inducible promoter, and wherein the second inducible promoter is an IPTG-inducible promoter.

Embodiment 52. The writing plasmid of embodiment 50, wherein the first inducible promoter is an anhydrotetracycline-inducible promoter, and wherein the second inducible promoter is an
    arabinose-inducible promoter.

Embodiment 53. The writing plasmid of embodiment 50, wherein the first inducible promoter is an anhydrotetracycline-inducible promoter, and wherein the second inducible promoter is a rhamnose-inducible promoter.

Embodiment 54. The writing plasmid of embodiment 50, wherein the first inducible promoter is an anhydrotetracycline-inducible promoter, and wherein the second inducible promoter is a phage shock promoter.

Embodiment 55. The writing plasmid of embodiment 50, wherein the first inducible promoter is a light-inducible promoter, and wherein the second inducible promoter is an IPTG-inducible promoter.

Embodiment 56. The writing plasmid of any one of embodiments 33-55, wherein the writing plasmid further comprises (iv) a nucleic acid sequence encoding a second sgRNA operably linked to a third promoter, wherein the second sgRNA is complementary to a target sequence, and wherein the second sgRNA associates with the napDNAbp under conditions that induce the expression of the fusion protein and the second sgRNA.

Embodiment 57. The writing plasmid of embodiment 56, wherein the third promoter is a constitutive promoter.

Embodiment 58. The writing plasmid of embodiment 57, wherein the constitutive promoter is a constitutive Lac promoter.

Embodiment 59. The writing plasmid of embodiment 56, wherein the third promoter is an inducible promoter.

Embodiment 60. The writing plasmid of embodiment 59, wherein the inducible promoter is a rhamnose-inducible promoter, IPTG-inducible promoter, anhydrotetracycline-inducible promoter, or arabinose-inducible promoter.

Embodiment 61. The writing plasmid of embodiment 56 comprising: (i) a nucleic acid sequence encoding a fusion protein comprising a napDNAbp and a nucleic acid editing domain operably linked to a first inducible promoter, (ii) a nucleic acid sequence encoding a first sgRNA operably linked to a second inducible promoter, wherein the first sgRNA is complementary to a target sequence, (iii) a nucleic acid sequence encoding a second sgRNA operably linked to a third inducible promoter, wherein the second sgRNA is complementary to a target sequence, and (iv) an origin of replication,
    wherein the first sgRNA associates with the napDNAbp only under conditions that induce the expression of the fusion protein and the expression of the first sgRNA, and wherein the second sgRNA associates with the napDNAbp only under conditions that induce the expression of the fusion protein and the expression of the second sgRNA.

Embodiment 62. The writing plasmid of embodiment 61, wherein the first inducible promoter is an anhydrotetracycline-inducible promoter, the second inducible promoter is an arabinose-inducible promoter, and the third inducible promoter is a rhamnose-inducible promoter.

Embodiment 63. The writing plasmid of any one of embodiments 33-62, wherein the writing plasmid further comprises (v) a nucleic acid sequence encoding a third sgRNA operably linked to a fourth promoter, wherein the third sgRNA is complementary to a target sequence, and wherein the third sgRNA associates with the napDNAbp under conditions that induce the expression of the fusion protein and expression of the third sgRNA.

Embodiment 64. The writing plasmid of embodiment 63, wherein the fourth promoter is a constitutive promoter.

Embodiment 65. The writing plasmid of embodiment 64, wherein the constitutive promoter is a constitutive Lac promoter.

Embodiment 66. The writing plasmid of embodiment 63, wherein the fourth promoter is an inducible promoter.

Embodiment 67. The writing plasmid of embodiment 66, wherein the inducible promoter is a rhamnose-inducible promoter, IPTG-inducible promoter, anhydrotetracycline-inducible promoter, or arabinose-inducible promoter.

Embodiment 68. The writing plasmid of embodiment 63 comprising: (i) a nucleic acid sequence encoding a fusion protein comprising a napDNAbp and a nucleic acid editing domain operably linked to a first inducible promoter, (ii) a nucleic acid sequence encoding a first sgRNA operably linked to a second inducible promoter, wherein the first sgRNA is complementary to a target sequence, (iii) a nucleic acid encoding a second sgRNA operably linked to a third inducible promoter, wherein the second sgRNA is complementary to a target sequence, (iv) a nucleic acid molecule encoding a third sgRNA operably linked to a fourth inducible promoter, wherein the third sgRNA is complementary to a target sequence, and (v) an origin of replication,
wherein the first sgRNA associates with the napDNAbp only under conditions that induce the expression of the fusion protein and the first sgRNA, and wherein the second sgRNA associates with the napDNAbp only under conditions that induce the expression of the fusion protein and the second sgRNA, and wherein the third sgRNA associates with the napDNAbp only under conditions that the expression of the fusion protein and the third sgRNA.

Embodiment 69. The writing plasmid of embodiment 68, wherein the first inducible promoter is an anhydrotetracycline-inducible promoter, the second inducible promoter is an IPTG-inducible promoter, the third inducible promoter is an arabinose-inducible promoter, and the fourth inducible promoter is a rhamnose-inducible promoter.

Embodiment 70. The writing plasmid of any one of embodiments 33-69, wherein the origin of replication comprises a origin of replication suitable for use in a bacterial cell.

Embodiment 71. The writing plasmid of embodiment 70, wherein the bacterial origin of replication comprises a pSC101, pMB1, pBR322, ColE1, p15A, or ChloDF13 origin of replication.

Embodiment 72. A bacterial cell comprising the writing plasmid of any one of embodiments 33-71.

Embodiment 73. A writing plasmid for use in a eukaryotic cell comprising:
(i) a nucleic acid sequence encoding a fusion protein comprising a nucleic acid programmable DNA binding protein (napDNAbp) and a nucleic acid editing domain operably linked to a first promoter; and
(ii) an origin of replication,
wherein the napDNAbp associates with an sgRNA under conditions that induce the expression of the fusion protein, and wherein the sgRNA is expressed by the eukaryotic cell.

Embodiment 74. The writing plasmid of embodiment 73, wherein the writing plasmid is used in combination with a second plasmid comprising (i) a nucleic acid sequence encoding a first sgRNA operably linked to a second promoter and (ii) an origin of replication.

Embodiment 75. The writing plasmid of embodiment 73 or 74, wherein the writing plasmid is used in combination with a third plasmid comprising (i) a nucleic acid sequence encoding a second sgRNA operably linked to a third promoter and (ii) an origin of replication.

Embodiment 76. The writing plasmid of any one of embodiments 73-75, wherein the writing plasmid is used in combination with a fourth plasmid comprising (i) a nucleic acid sequence encoding a third sgRNA operably linked to a fourth promoter and (ii) an origin of replication.

Embodiment 77. The writing plasmids of any one of embodiments 73-76, wherein the first, second, and third sgRNAs are each independently complementary to a different target sequence.

Embodiment 78. The writing plasmid of any one of embodiments 73-76, wherein the first, second, third, and/or fourth promoter is an inducible promoter.

Embodiment 79. The writing plasmid of any one of embodiments 73-76, wherein the first, second, third, and/or fourth promoter is a constitutive promoter.

Embodiment 80. The writing plasmid of embodiment 79, wherein the first promoter is a constitutive CMV promoter.

Embodiment 81. The writing plasmid of embodiment 58e, wherein the second, third, and fourth constitutive promoters are U6 promoters.

Embodiment 82. A writing plasmid for use in a eukaryotic cell comprising:
(i) a nucleic acid sequence encoding a fusion protein comprising a nucleic acid programmable DNA binding protein (napDNAbp) and a nucleic acid editing domain operably linked to a first promoter;
(ii) a nucleic acid sequence encoding a sgRNA operably linked to a second promoter, wherein the sgRNA is complementary to a target sequence; and
(iii) an origin of replication,
wherein at least one of the promoters is an inducible promoter, and wherein the sgRNA associates with the napDNAbp under conditions that induce the expression of the fusion protein and expression of the sgRNA.

Embodiment 83. The writing plasmid of embodiment 82, wherein the first promoter is a constitutive promoter.

Embodiment 84. The writing plasmid of embodiment 83, wherein the constitutive promoter is a cytomegalovirus (CMV) promoter, a constitutive RNA polymerase III promoter, or a UBC promoter.

Embodiment 85. The writing plasmid of embodiment 82, wherein the first promoter is a promoter induced by a stimulus.

Embodiment 86. The writing plasmid of embodiment 85, wherein the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.

Embodiment 87. The writing plasmid of embodiment 86, wherein the stimulus is forskolin.

Embodiment 88. The writing plasmid of embodiment 86, wherein the stimulus is lithium chloride (LiCl).

Embodiment 89. The writing plasmid of embodiment 86, wherein the stimulus is phorbol 12-myristate 13-acetate (PMA).

Embodiment 90. The writing plasmid of embodiment 86, wherein the stimulus is dexamethasone.
Embodiment 91. The writing plasmid of embodiment 86, wherein the stimulus is all-trans retinoic acid (ATRA).
Embodiment 92. The writing plasmid of embodiment 86, wherein the stimulus is calcitriol.
Embodiment 93. The writing plasmid of embodiment 86, wherein the stimulus is sulforaphane.
Embodiment 94. The writing plasmid of embodiment 86, wherein the stimulus is 2,3,7,8-Tetrachlorodibenzodioxin (TCDD).
Embodiment 95. The writing plasmid of embodiment 86, wherein the stimulus is an antibiotic.
Embodiment 96. The writing plasmid of embodiment 86 or 87, wherein the stimulus is doxycycline.
Embodiment 97. The writing plasmid of embodiment 86 or 87, wherein the stimulus is tanespimycin.
Embodiment 98. The writing plasmid of embodiment 86 or 87, wherein the stimulus is tunicamycin.
Embodiment 99. The writing plasmid of embodiments 85, wherein the promoter is a tetracycline-inducible promoter.
Embodiment 100. The writing plasmid of embodiment 85 or 86, wherein the inducible promoter is induced by a signaling molecule produced during an activated endogenous or exogenous cell signaling cascade.
Embodiment 101. The writing plasmid of embodiment 100, wherein the inducible promoter is induced by a signaling molecule produced during an activated NF-κB, SMADs, Signal Transducer and Activator of Transcription 1 (STAT1), STAT2, STAT3, interferon regulatory factor-1 (IRF-1), E2F, cAMP Response Element-Binding protein (CREB), CCAAT-Enhancer-Binding protein (C/EBP), Serum Response Factor (SRF), Nuclear Factor of Activated T-cells (NFAT), Glucocorticoid Receptor (GR), Mitogen Activated Protein Kinase/c-Jun N-terminal Kinase (MAPK/JNK), GATA transcription factor (GATA), Retinoic Acid Receptor (RAR), Retinoid X Receptor (RXR), Vitamin D Receptor (VDR), Adenylate-Uridylate element (ARE), Xenobiotic/Dioxin-Responsive Element (XRE/DRE), Heat Shock Factor (HSF), Activating Transcription Factor 6 (ATF6), or a CCAAT-binding Factor/Nuclear Transcription Factor Y/Transcriptional Factor Yin Yang 1 (CBF/NF-Y/YY1) signaling cascade.
Embodiment 102. The writing plasmid of claim 100, wherein the signaling molecule is Tumor Necrosis Factor (TNF), Transforming Growth Factor β (TGF-β), Interleukin 6 (IL-6), Interferon α (IFNα), IFNγ, Epidermal Growth Factor (EGF).
Embodiment 103. The writing plasmid of embodiment 100, wherein the inducible promoter is induced by a signaling molecule produced during an activated Wnt signaling cascade.
Embodiment 104. The writing plasmid of embodiment 103, wherein the signaling molecule produced during the activated Wnt signaling cascade is beta-catenin.
Embodiment 105. The writing plasmid of embodiment 73 or 82, wherein the target sequence is present in a safe harbor locus.
Embodiment 106. The writing plasmid of embodiment 105, wherein the safe harbor locus is present in a CCR5 gene locus.
Embodiment 107. The writing plasmid of embodiment 73 or 82, wherein the second promoter is a constitutive promoter.
Embodiment 108. The writing plasmid of embodiment 107, wherein the second promoter is a cytomegalovirus (CMV) promoter, a constitutive RNA polymerase III promoter, or a UBC promoter.
Embodiment 109. The writing plasmid of embodiment 73 or 82, wherein the second promoter is an inducible promoter.
Embodiment 110. The writing plasmid of embodiment 109, wherein the second promoter is an inducible RNA polymerase III promoter.
Embodiment 111. The writing plasmid of embodiment 109 or 110, wherein the inducible promoter is an IPTG-inducible RNA polymerase III promoter or a tetracycline-inducible RNA polymerase III promoter.
Embodiment 112. The writing plasmid of embodiment 108 or 110, wherein the RNA polymerase III promoter is a U6 promoter.
Embodiment 113. The writing plasmid of embodiment 108 or 110, wherein the RNA polymerase III promoter is a H1 promoter.
Embodiment 114. The writing plasmid of embodiment 82 comprising: (i) a nucleic acid sequence encoding a fusion protein comprising a napDNAbp and a nucleic acid editing domain operably linked to an inducible promoter, (ii) a nucleic acid encoding a sgRNA operably liked to a constitutive promoter, wherein the sgRNA is complementary to a target sequence, and (iii) an origin of replication,
  wherein the sgRNA is constitutively expressed, and
    wherein the sgRNA associates with the napDNAbp under conditions that induce the expression of the fusion protein.
Embodiment 115. The writing plasmid of embodiment 114, wherein the inducible promoter is a tetracycline-inducible promoter, and wherein the constitutive promoter is a constitutive RNA polymerase III U6 promoter.
Embodiment 116. The writing plasmid of embodiment 114, wherein the inducible promoter is induced by a signaling molecule produced during an activated Wnt signaling cascade, and wherein the constitutive promoter is a constitutive U6 promoter.
Embodiment 117. The writing plasmid of any one of embodiments 82-116, wherein the nucleic acid sequence of (i) or (ii) further comprises a nucleic acid sequence encoding a reporter protein.
Embodiment 118. The writing plasmid of embodiment 117, wherein the nucleic acid sequence encoding the reporter protein is connected to the 3' end of the nucleic acid sequence of (i) by an intervening P2A sequence.
Embodiment 119. The writing plasmid of embodiment 117 or 118, wherein the reporter protein is a luciferase protein.
Embodiment 120. The writing plasmid of any one of embodiments 82-119, wherein the writing plasmid is used in combination with (i) a second plasmid comprising a nucleic acid sequence encoding a sgRNA operably linked to a constitutive promoter comprising a repressor binding site, wherein the sgRNA is complementary to a target sequence; and (ii) a third plasmid comprising a nucleic acid sequence encoding one or more repressor proteins operably linked to a second constitutive promoter,
  wherein the repressor protein and the sgRNA are constitutively expressed, and wherein the repressor protein binds to the repressor binding site of the first constitutive promoter.
Embodiment 121. The writing plasmid of embodiment 120, wherein the nucleic acid sequence of (ii) encodes one repressor protein.
Embodiment 122. The writing plasmid of embodiment 121, wherein the repressor protein is a tetracycline repressor protein (TetR) or a lactose repressor protein (LacI).
Embodiment 123. The writing plasmid of embodiment 120, wherein the nucleic acid sequence of (ii) encodes a first repressor protein and a second repressor protein, and wherein an intervening P2A sequence separates the nucleic acid sequences encoding the first and second repressor proteins.

Embodiment 124. The writing plasmid of embodiment 123, wherein the first repressor protein is a tetracycline repressor protein (TetR) or a lactose repressor protein (LacI) and the second repressor protein is a tetracycline repressor protein (TetR) or a lactose repressor protein (LacI), wherein the first repressor protein and the second repressor protein are not the same.

Embodiment 125. The writing plasmid of embodiment 124, wherein the Lac repressor protein cannot bind to the repressor binding site in the presence of IPTG.

Embodiment 126. The writing plasmid of embodiment 124, wherein the tetracycline repressor protein cannot bind to the repressor binding site in the presence of a tetracycline molecule.

Embodiment 127. The writing plasmid of embodiment 126, wherein the tetracycline molecule is doxycycline.

Embodiment 128. The writing plasmid of any one of embodiments 120-127, wherein the writing plasmid is used with a fourth plasmid comprising a nucleic acid encoding a second sgRNA operably linked to a third constitutive promoter comprising a second repressor binding site, wherein the second sgRNA is complementary to a target sequence, and wherein the second repressor protein and the second sgRNA are constitutively expressed, and wherein the second repressor protein binds to the second repressor binding site of the third constitutive promoter.

Embodiment 129. The writing plasmid of embodiment 128, wherein the first, second, and/or third constitutive promoter is a CMV promoter, a U6 promoter, a H1 promoter, or a UBC promoter.

Embodiment 130. The writing plasmid of any one of embodiments 120-128, wherein the first, the second, and/or the third constitutive promoters are different constitutive promoters.

Embodiment 131. The writing plasmid of embodiment 108, wherein the first constitutive promoter is a U6 promoter comprising a Lac repressor protein binding site, the second constitutive promoter is a UBC promoter, and the third constitutive promoter is a H1 promoter comprising a tetracycline repressor protein binding site.

Embodiment 132. The writing plasmid of any one of embodiments 73-131, wherein the origin of replication is a origin of replication suitable for use in a eukaryotic cell.

Embodiment 133. The writing plasmid of embodiment 132, wherein the origin of replication is a ChloE1 origin of replication.

Embodiment 134. The writing plasmid of any one of embodiments 73-133, wherein the sgRNA is expressed in a cell but is not encoded by the writing plasmid.

Embodiment 135. A eukaryotic cell comprising the writing plasmid of any of embodiments 73-134.

Embodiment 136. The writing plasmid of any one of embodiments 33-134, wherein the napDNAbp comprises a Cas9 domain, a Cpf1, a CasX, a CasY, a C2c1, a C2c2, or a C2c3.

Embodiment 137. The writing plasmid of embodiment 136, wherein the Cas9 domain is a nuclease inactive Cas9 (dCas9) domain, a Cas9 nickase (Cas9n) domain, or a nuclease active Cas9 domain.

Embodiment 138. The writing plasmid of embodiment 136 or 137, wherein the Cas9 domain is a Cas9 domain from *Streptococcus pyogenes* (spCas9).

Embodiment 139. The writing plasmid of any one of embodiments 136-138, wherein the Cas9 domain is a dCas9 domain that comprises a D10A and a H840A mutation in the amino acid sequence provided by SEQ ID NO: 10, or a corresponding mutation in any of the amino acid sequences provided in SEQ ID NOs: 11-260.

Embodiment 140. The writing plasmid of any one of embodiments 136-138, wherein the Cas9 domain is a Cas9n domain that comprises a D10A or a H840A mutation in the amino acid sequence provided by SEQ ID NO: 10, or a corresponding mutation in any of the amino acid sequences provided in SEQ ID NOs: 11-260.

Embodiment 141. The writing plasmid of any one of embodiments 136-138, wherein the Cas9 domain comprises the amino acid sequence of SEQ ID NO: 6.

Embodiment 142. The writing plasmid of any one of embodiments 136-138, wherein the Cas9 domain comprises the amino acid sequence of SEQ ID NO: 7.

Embodiment 143. The writing plasmid of any one of embodiments 33-134, wherein the nucleic acid editing domain comprises a deaminase, a nuclease, a nickase, a recombinase, a methyltransferase, a methylase, an acetylase, an acetyltransferase, a transcriptional activator, or a transcriptional repressor domain.

Embodiment 144. The writing plasmid of embodiment 143, wherein the nucleic acid editing domain comprises a deaminase domain.

Embodiment 145. The writing plasmid of embodiment 144, wherein the deaminase domain is a cytidine deaminase domain.

Embodiment 146. The writing plasmid of embodiment 145, wherein the cytidine deaminase domain is a deaminase domain from the apolipoprotein B mRNA-editing complex (APOBEC) family.

Embodiment 147. The writing plasmid of embodiment 146, wherein the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

Embodiment 148. The writing plasmid of any one of embodiments 33-134, wherein the fusion protein comprises a Cas9 domain and a cytidine deaminase domain, wherein the Cas9 domain and the cytidine deaminase domain are linked via a linker.

Embodiment 149. The writing plasmid of embodiment 148, wherein the linker comprises the amino acid sequence SGSETPGTSESATPES (SEQ ID NO: 306).

Embodiment 150. The writing plasmid of any one of embodiments 148-149, wherein the fusion protein comprises the amino acid sequence of any one of SEQ ID NOs: 540-542.

Embodiment 151. The writing plasmid of any one of embodiments 33-134, wherein the fusion protein comprises one or more deaminase domains.

Embodiment 152. The writing plasmid of embodiment 151, wherein the fusion protein comprises two deaminase domains.

Embodiment 153. The writing plasmid embodiment 151 or 152, wherein one or more of the deaminase domains is an adenosine deaminase domain.

Embodiment 154. The writing plasmid of embodiment 153, wherein the adenosine deaminase domain comprises an ecTadA domain, or variant thereof.

Embodiment 155. The writing plasmid of embodiment 154, wherein the ecTadA domain comprises the amino acid sequence of any one of SEQ ID NOs: 400-480.

Embodiment 156. The writing plasmid of any one of embodiments 151-155, wherein the fusion protein comprises a Cas domain and one or more adenosine deaminase domains, wherein the Cas domain and one or more of the adenosine deaminase domains are linked via a linker.

Embodiment 157. The writing plasmid of embodiment 156, wherein the linker comprises the amino acid sequence of any one of SEQ ID NOs: 300-318.

Embodiment 158. The writing plasmid of any one of embodiments 148-157, wherein the fusion protein further comprises a uracil glycosylase inhibitor (UGI) domain.

Embodiment 159. The writing plasmid of embodiment 158, wherein the fusion protein comprises the amino acid sequence of any one of SEQ ID NOs: 543-550.

Embodiment 160. The writing plasmid of embodiment 159, wherein the fusion protein comprises the amino acid sequence of SEQ ID NO: 543.

Embodiment 161. The writing plasmid of embodiment 159, wherein the fusion protein comprises the amino acid sequence of SEQ ID NO: 544.

Embodiment 162. The writing plasmid of any one of embodiments 151-158, wherein the fusion protein comprises the amino acid sequence of SEQ ID NO: 560-586.

Embodiment 163. A recording plasmid comprising (i) a target sequence complementary to a sgRNA, and (ii) an origin or replication.

Embodiment 164. The recording plasmid of embodiment 163, wherein the sgRNA is expressed in a cell.

Embodiment 165. The recording plasmid of embodiment 163, wherein the sgRNA is not encoded by a writing plasmid.

Embodiment 166. The recording plasmid of embodiment 163, wherein the sgRNA is encoded by a plasmid separate from the writing plasmid.

Embodiment 167. The recording plasmid of embodiment 163, wherein target sequence is present in a reporter gene.

Embodiment 168. The recording plasmid of embodiment 167, wherein the reporter gene is an EGFP gene.

Embodiment 169. The recording plasmid of embodiment 168, wherein the EGFP gene comprises a nucleic acid sequence that encodes an EGFP protein, or variant thereof.

Embodiment 170. The recording plasmid of embodiment 169, wherein the EGFP protein, or variant thereof, comprises an amino acid sequence that is at least about 90% identical to the amino acid sequence of SEQ ID NO: 600.

Embodiment 170. The recording plasmid of embodiment 169, wherein the EGFP protein is a wild-type EGFP protein, and wherein the wild-type EGFP protein produces fluorescence.

Embodiment 171. The recording plasmid of embodiment 170, wherein the wild-type EGFP protein comprises the amino acid sequence of SEQ ID NO: 660.

Embodiment 172. The recording plasmid of embodiment 169, wherein the EGFP protein is a truncated EGFP protein, and wherein the truncated EGFP protein does not fluoresce.

Embodiment 173. The recording plasmid of embodiment 169, wherein the EGFP protein comprises a an amino acid sequence comprising one or more amino acid insertions, deletions, or mutations relative to the amino acid sequence of SEQ ID NO: 600.

Embodiment 174. The recording plasmid of any one of embodiments 163, wherein the recording plasmid further comprises one or more nucleic acid sequences, wherein each nucleic acid sequence encodes an antibiotic resistance protein, or variant thereof.

Embodiment 175. The recording plasmid of embodiment 174, wherein the antibiotic resistance protein is chloramphenicol acetyltransferase (Cat), and wherein the Cat protein confers chloramphenicol resistance.

Embodiment 176. The recording plasmid of embodiment 175, wherein the Cat protein comprises the amino acid sequence of SEQ ID NO: 665.

Embodiment 177. The recording plasmid of embodiment 174, wherein the antibiotic resistance protein is aminoglycoside-3'-phosphotransferase (Aph3'), and wherein the Aph3' protein confers kanamycin resistance.

Embodiment 178. The recording plasmid of embodiment 177, wherein the Aph3'protein comprises the amino acid sequence of SEQ ID NO: 666.

Embodiment 179. The recording plasmid of any one of embodiments 174-175, wherein the antibiotic resistance protein is a variant comprising one or more mutations that inactivate the antibiotic resistance protein.

Embodiment 180. The recording plasmid of embodiment 179, wherein the variant is a Cat variant comprising a H195A mutation in the amino acid sequence provided by SEQ ID NO: 665, and wherein the H195A mutation results in a Cat protein that does not confer chloramphenicol resistance.

Embodiment 181. The recording plasmid of embodiment 179, wherein the variant is a Aph3' protein comprising a D208A mutation in the amino acid sequence provided by SEQ ID NO: 666, and wherein the D208A mutation results in a Aph3' protein that does not confer kanamycin resistance.

Embodiment 182. The recording plasmid of any one of embodiments 174-181, wherein the recording plasmid comprises a nucleic acid sequence encoding a Cat protein, or variant thereof, and a nucleic acid sequence encoding a Aph3' protein, or variant thereof.

Embodiment 183. The recording plasmid of embodiment 182, wherein the recording plasmid comprises (a) a nucleic acid sequence encoding a Cat variant comprising a H195A mutation in the amino acid sequence provided by SEQ ID NO: 665, wherein the H195A mutation results in a Cat protein that does not confer chloramphenicol resistance, and (b) a nucleic acid sequence encoding aminoglycoside-3'-phosphotransferase (Aph3'), wherein the Aph3' protein confers kanamycin resistance.

Embodiment 184. The recording plasmid of embodiment 182, wherein the recording plasmid comprises (a) a nucleic acid sequence encoding chloramphenicol acetyltransferase (Cat), and wherein the Cat protein confers chloramphenicol resistance, and (b) a nucleic acid sequence encoding a Aph3' protein comprising a D208A mutation in the amino acid sequence provided by SEQ ID NO: 666, and wherein the D208A mutation results in a Aph3' protein that does not confer kanamycin resistance.

Embodiment 185. The recording plasmid of any one of embodiments 163-184, wherein the origin of replication is an origin of replication suitable for use in a bacterial cell.

Embodiment 186. The recording plasmid of embodiment 185, wherein the origin of replication is a pUC origin of replication.

Embodiment 187. The recording plasmid of embodiment 185, wherein the origin of replication is a RSF1030 origin of replication.

Embodiment 188. A cell data recorder system for use in a prokaryotic cell comprising:
(a) the writing plasmid of any one of embodiments 1-31;
(b) a first recording plasmid selected from the recording plasmids of any one of embodiments 163-186; and
(c) a second recording plasmid selected from the recording plasmids of any one of embodiments 163-186, and wherein the first recording plasmid and the second recording plasmid are not the same.

Embodiment 189. The cell data recorder system of embodiment 188, wherein the first recording plasmid is the recording plasmid of embodiment 171.

Embodiment 190. The cell data recorder system of embodiment 188, wherein the second recording plasmid is the recording plasmid of embodiment 172.

Embodiment 191. The cell data recorder system of embodiment 188, wherein the first recording plasmid is the recording plasmid of embodiment 183.

Embodiment 192. The cell data recorder system of embodiment 188, wherein the second recording plasmid is the recording plasmid of embodiment 184.

Embodiment 193. A cell data recorder system for use in a prokaryotic cell comprising:
(i) the writing plasmid of any one of embodiments 33-71; and
(ii) one or more recording plasmids selected from the recording plasmids of any one of embodiments 163-186.

Embodiment 194. The cell data recorder system of embodiment 193, wherein the system comprises one recording plasmid.

Embodiment 195. The cell data recorder system of embodiment 194, wherein the recording plasmid is the recording plasmid of embodiment 171.

Embodiment 196. The cell data recorder system of embodiment 194, wherein the recording plasmid is the recording plasmid of embodiment 173.

Embodiment 197. The cell data recorder system of embodiment 194, wherein the recording plasmid is the recording plasmid of embodiment 187.

Embodiment 198. A cell data recorder system for use in eukaryotic cells comprising:
(i) the writing plasmid of any one of embodiments 73-114; and
(ii) one or more recording loci,
wherein each of the one or more recording loci comprises a target sequence complementary to an sgRNA expressed in the cell.

Embodiment 199. The cell data recorder system of embodiment 198, wherein the sgRNA is encoded by a plasmid.

Embodiment 200. The cell data recorder system of embodiment 198 or 199, wherein the sgRNA is encoded by the writing plasmid, and wherein the nucleic acid sequence encoding the sgRNA is operably linked to a promoter.

Embodiment 201. The cell data recorder system of embodiment 198, wherein the target sequence is present in a safe harbor locus.

Embodiment 202. The cell data recorder system of embodiment 201, wherein the safe harbor locus is located in the CCR5 gene.

Embodiment 203. A kit for use in a prokaryotic cell comprising the cell data recorder system of any one of embodiments 188-197.

Embodiment 204. A kit for use in a eukaryotic cell comprising the cell data recorder system of any one of embodiments 198-202.

Embodiment 205. A prokaryotic cell comprising the cell data recorder system of any one of embodiments 188-197.

Embodiment 206. The cell of embodiment 203 or 205, wherein the prokaryotic cell is a bacterial cell.

Embodiment 207. The cell of embodiment 206, wherein the bacterial cell is an *E. coli* cell.

Embodiment 208. A eukaryotic cell comprising the cell data recorder system of any one of embodiments 198-202.

Embodiment 209. The cell of embodiment 204 or 208, wherein the eukaryotic cell is a mammalian cell.

Embodiment 210. The cell of embodiment 209, wherein the mammalian cell is a human cell.

Embodiment 211. A method for engineering a cell, the method comprising:
contacting the cell with the cell data recorder system of any one of embodiments 188-Embodiment 192.

Embodiment 212. The method of embodiment 211, wherein the writing plasmid, the first recording plasmid, and/or the second recording plasmid are transfected into the cell.

Embodiment 213. The method of embodiment 211, wherein the writing plasmid is transfected into the cell.

Embodiment 214. The method of embodiment 211, wherein the first recording plasmid is transfected into the cell.

Embodiment 215. The method of embodiment 211, wherein the second recording plasmid is transfected into the cell.

Embodiment 216. The method of any one of embodiments 211-215, wherein the writing plasmid, the first recording plasmid, and/or the second recording plasmid is transfected into the cell via electroporation.

Embodiment 217. The method of any one of embodiments 211-215, wherein the writing plasmid, the first recording plasmid, and/or the second recording plasmid is transfected into the cell via heat shock.

Embodiment 218. The method of any one of embodiments 211-215, wherein the writing plasmid, the first recording plasmid, and/or the second recording plasmid is transfected into the cell via a composition comprising a cationic lipid reagent.

Embodiment 219. The method of any one of embodiments 211-218, wherein from 50 ng to 150 ng of the writing plasmid is used in a transfection reaction for transfecting the cell.

Embodiment 220. The method of any one of embodiments 211-218, wherein from 400 ng to 600 ng of the first recording plasmid is used in a transfection reaction for transfecting the cell.

Embodiment 221. The method of any one of embodiments 211-218, wherein from 400 ng to 600 ng of the second recording plasmid is used in a transfection reaction for transfecting the cell.

Embodiment 222. The method of any one of embodiments 211-221, wherein the cell is a prokaryotic cell.

Embodiment 223. The method of embodiment 222, wherein the prokaryotic cell is a bacterial cell.

Embodiment 224. The method of any one of embodiments 223, wherein the bacterial cell is an *Escherichia coli* (*E. coli*) cell.

Embodiment 225. The method of embodiment 224, wherein the *E. coli* cell is an *E. coli* S1030 cell.

Embodiment 226. A method for engineering a cell, the method comprising:
contacting the cell with the cell data recorder system of any one of embodiments 193-197.

Embodiment 227. The method of embodiment 226, wherein the writing plasmid, and/or the one or more recording plasmids are transfected into the cell.

Embodiment 228. The method of embodiment 226 or 227, wherein the writing plasmid is transfected into the cell.

Embodiment 229. The method of embodiment 226 or 227, wherein the one or more recording plasmids are transfected into the cell.

Embodiment 230. The method of any one of embodiments 226-229, wherein the writing plasmid and/or the one or more recording plasmids are transfected into the cell via electroporation.

Embodiment 231. The method of any one of embodiments 226-229, wherein the writing plasmid and/or the one or more recording plasmids are transfected into the cell via heat shock.

Embodiment 232. The method of any one of embodiments 226-229, wherein the writing plasmid and/or the one or more recording plasmids are transfected into the cell via a cationic lipid reagent.

Embodiment 233. The method of any one of embodiments 226-232, wherein from 50 ng to 150 ng of the writing plasmid is used in a transfection reaction for transfecting the cell.

Embodiment 234. The method of any one of embodiments 226-232, wherein from 400 ng to 600 ng of the one or more recording plasmids are used in a transfection reaction for transfecting the cell.

Embodiment 235. The method of any one of embodiments 226-234, wherein the cell is a prokaryotic cell.

Embodiment 236. The method of embodiment 235, wherein the prokaryotic cell is a bacterial cell.

Embodiment 237. The method of embodiment 236, wherein the bacterial cell is an *Escherichia coli* (*E. coli*) cell.

Embodiment 238. The method of embodiment 237, wherein the *E. coli* cell is an *E. coli* S1030 cell or an *E. coli* S2063 cell.

Embodiment 239. A method for engineering a cell, the method comprising:
contacting the cell with the cell data recorder system of any one of embodiments 198-202.

Embodiment 240. The method of embodiment 239, wherein the writing plasmid and/or a plasmid encoding the sgRNA complementary to the target sequence are transfected into the cell.

Embodiment 241. The method of embodiment 239 or 240, wherein the writing plasmid is transfected into the cell.

Embodiment 242. The method of embodiment 239 or 240, wherein the plasmid expressing the sgRNA complementary to the target sequence is transfected into the cell.

Embodiment 243. The method of any one of embodiments 239-242, wherein the sgRNA complementary to the target sequence is encoded by a plasmid different from the writing plasmid.

Embodiment 244. The method of any one of embodiments 239-242, wherein the sgRNA complementary to the target sequence is encoded by the writing plasmid.

Embodiment 245. The method of any one of embodiments 239-244, wherein the writing plasmid and/or the plasmid encoding the sgRNA are transfected into the cell via electroporation.

Embodiment 246. The method of any one of embodiments 239-244, wherein the writing plasmid and/or the plasmid encoding the sgRNA are transfected into the cell via heat shock.

Embodiment 247. The method of any one of embodiments 239-244, wherein the writing plasmid and/or the plasmid encoding the sgRNA are transfected into the cell via a cationic lipid reagent.

Embodiment 248. The method of embodiment 247, wherein the cationic lipid reagent is Lipofectamine® 2000.

Embodiment 249. The method of any one of embodiments 239-248, wherein from 700 ng to 900 ng of the writing plasmid is used in a transfection reaction for transfecting the cell.

Embodiment 250. The method of any one of embodiments 239-248, wherein from 10 ng to 60 ng of the plasmid encoding the sgRNA is used in a transfection reaction for transfecting the cell.

Embodiment 251. The method of any one of embodiments 239-250, wherein the cell is a eukaryotic cell.

Embodiment 252. The method of embodiment 251, wherein the eukaryotic cell is a mammalian cell.

Embodiment 253. The method of embodiment 252, wherein the mammalian cell is a human cell.

Embodiment 254. The method of any one of embodiments 253, wherein the human cell is a HEK293T cell.

Embodiment 255. The method of embodiment 240-244, wherein the target sequence is present in a safe harbor locus.

Embodiment 256. The method of any one of embodiments 255, wherein the target sequence is present in a safe harbor locus in the CCR5 gene.

Embodiment 257. A method for recording the presence and/or duration of a stimulus in an engineered cell, the method comprising:
(i) providing an engineered cell comprising the cell data recorder system of any one of embodiments 188-192; and
(ii) determining an amount of the first recording plasmid (R1) and an amount of the second recording plasmid (R2) in the engineered cell.

Embodiment 258. The method of embodiment 257, wherein the engineered cell is produced by the method of any one of embodiments 211-225.

Embodiment 259. The method of embodiment 257 or 258, wherein the napDNAbp of the cell data recorder system is associated with a sgRNA complementary to the target sequence of R1, and wherein the sgRNA is not complementary to the target sequence of R2.

Embodiment 260. The method of embodiment 259, wherein the sgRNA is encoded by the writing plasmid, and wherein the nucleic acid sequence encoding the sgRNA is operably linked to a promoter.

Embodiment 261. The method of embodiment 259, wherein the napDNAbp is a nuclease active Cas9 domain.

Embodiment 262. The method of embodiment 259, wherein the target sequence of R1 is present in a reporter gene encoding a functional reporter protein.

Embodiment 263. The method of embodiment 262, wherein the functional reporter protein is a fluorescent protein.

Embodiment 264. The method of embodiment 263, wherein the fluorescent protein is EGFP.

Embodiment 265. The method of embodiment 259, wherein the target sequence of R2 is present in a reporter gene encoding a non-functional reporter protein.

Embodiment 266. The method of embodiment 265, wherein the non-functional reporter protein does not fluoresce.

Embodiment 267. The method of embodiment 257 or 258, wherein the amount of the first recording plasmid (R1), and/or the amount of the second recording plasmid (R2) is determined using high-throughput sequencing of the amplified target sequence of R1 and/or R2.

Embodiment 268. The method of embodiment 257 or 258, wherein the amount of the first recording plasmid (R1) is determined using high-throughput sequencing of the amplified target sequence of R1.

Embodiment 269. The method of embodiment 257 or 258, wherein the amount of the second recording plasmid (R2) is determined using high-throughput sequencing of the amplified target sequence of R2.

Embodiment 270. The method of embodiment 257 or 258, wherein the amount of the first recording plasmid (R1), and/or the second recording plasmid (R2) is determined by measuring a level of fluorescence from the cell.

Embodiment 271. The method of embodiment 270, wherein the level of fluorescence from the cell corresponds to the amount of functional reporter protein expressed in the cell.
Embodiment 272. The method of any one of embodiments 257-271, wherein the cell is not contacted with a stimulus.
Embodiment 273. The method of any one of embodiments 257-271, wherein further comprising contacting the cell with a stimulus, wherein the stimulus induces the expression of the napDNAbp and/or the sgRNA encoded by the writing plasmid.
Embodiment 274. The method of embodiment 273, wherein the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.
Embodiment 275. The method of any one of embodiments 273-274, wherein the cell is contacted with the stimulus at least once.
Embodiment 276. The method of embodiment 275, wherein the napDNAbp introduces a DNA double-strand break in the target sequence of R1, thereby reducing the amount of R1.
Embodiment 277. The method of embodiment 275, wherein the napDNAbp introduces a DNA double-strand break in the target sequence of R1, thereby reducing the amount of functional reporter protein expressed in the cell.
Embodiment 278. The method of any one of embodiments 273-277, wherein the cell is contacted with the stimulus at least two, three, four, five, six, seven, eight, nine, or ten times.
Embodiment 279. The method of any one of embodiments 257-278, wherein the determining of (ii) is performed one, two, three, four, five, six, seven, eight, nine, or ten times.
Embodiment 280. The method of any one of embodiments 257-279, further comprising (iii) determining a ratio of the amount of the first recording plasmid (R1) and the amount of the second recording plasmid (R2).
Embodiment 281. The method of embodiment 280, wherein the ratio of R1 to R2 is determined when the cell is not contacted with the stimulus.
Embodiment 282. The method of embodiment 280, wherein the ratio is determined when the cell is contacted with the stimulus.
Embodiment 283. The method of embodiment 282, wherein the cell is contacted with the stimulus at least once.
Embodiment 284. The method of embodiment 282 or 283, wherein the cell is contacted with the stimulus at least two, three, four, five, six, seven, eight, nine, or ten times.
Embodiment 285. The method of any one of embodiments 280-284, wherein the determining of (iii) is performed one, two, three, four, five, six, seven, eight, nine, or ten times.
Embodiment 286. The method of any one of embodiments 280-284, further comprising (iv) comparing the ratio of R1 to R2 in the presence of the stimulus to the ratio of R1 to R2 in the absence of the stimulus.
Embodiment 287. The method of embodiment 286, wherein the ratio of R1 to R2 does not significantly change in the absence of the stimulus.
Embodiment 288. The method of embodiment 286, wherein a change in the ratio of R1 to R2 indicates the presence of the stimulus.
Embodiment 289. The method of embodiment 288, wherein the ratio of R1 to R2 decreases in the presence of the stimulus.
Embodiment 290. The method of embodiment 289, wherein the ratio of R1 to R2 decreases by at least 1%, 5%, 10%, 15%, 20%, 25%, 30%, 35%, 40%, 45%, 50%, 55%, or 65% in the presence of the stimulus.
Embodiment 291. The method of embodiment 289, wherein the ratio of R1 to R2 decreases by at least 2-fold, 3-fold, 4-fold, or 5-fold in the presence of the stimulus.
Embodiment 292. The method of any one of embodiments 286-291, wherein the comparing of (iv) is performed one, two, three, four, five, six, seven, eight, nine, or ten times.
Embodiment 293. The method of any one of embodiments 286-292 further comprising (iv) resetting the amount of the first recording plasmid (R1) and the amount of the second recording plasmid (R2) in the engineered cell.
Embodiment 294. The method of embodiment 293, wherein the first recording plasmid is the recording plasmid of embodiment 171.
Embodiment 295. The method of embodiment 293, wherein the second recording plasmid is the recording plasmid of embodiment 172.
Embodiment 296. The method of embodiment 293, wherein the resetting comprises contacting the cell with an antibiotic.
Embodiment 297. The method of embodiment 296, wherein the cell is contacted with between 1 µg/mL and 20 µg/mL of the antibiotic.
Embodiment 298. The method of embodiment 296 or 297, wherein the antibiotic is chloramphenicol and/or kanamycin.
Embodiment 299. The method of embodiment 298, wherein the antibiotic reduces the amount of R2.
Embodiment 300. The method of embodiment 299, wherein the antibiotic is kanamycin.
Embodiment 301. The method of any one of embodiments 293-300, wherein the resetting comprises contacting the cell with a second antibiotic.
Embodiment 302. The method of embodiment 301, wherein the cell is contacted with between 1 µg/mL and 20 µg/mL of the second antibiotic.
Embodiment 303. The method of embodiment 302, wherein the second antibiotic reduces the amount of R1.
Embodiment 304. The method of embodiment 302 or 303, wherein the second antibiotic is chloramphenicol.
Embodiment 305. The method of any one of embodiments 293-304, wherein the resetting is achieved by contacting the cell with the first antibiotic and/or the second antibiotic for at least 6 hours, 8 hours, 10 hours, 12 hours, 24 hours, or more.
Embodiment 306. The method of any one of embodiments 293-304, wherein the cell is contacted with the first antibiotic and/or the second antibiotic at least once.
Embodiment 307. The method of embodiment 306, wherein the cell is contacted with the first antibiotic and/or the second antibiotic at least two, at least three, at least four, at least five, at least six, at least seven, at least eight, at least nine, or at least ten times.
Embodiment 308. The method of any one of embodiments 293-307, wherein the ratio of R1 to R2 after resetting is within 1%, 2%, 3%, 4%, 5%, 6%, 7%, 8%, 9%, or 10% of the ratio after the cell has been exposed to the stimulus.
Embodiment 309. The method of any one of embodiments 273-308, wherein the cell is exposed to a second stimulus, and wherein the second stimulus induces expression of the napDNAbp and/or expression of the sgRNA encoded by the writing plasmid.

Embodiment 310. The method of embodiment 309, wherein the second stimulus induces expression of the napDNAbp, the first sgRNA, and/or the second sgRNA encoded by the writing plasmid.
Embodiment 311. The method of embodiment 310, wherein the second stimulus induces expression of the napDNAbp encoded by the writing plasmid.
Embodiment 312. The method of embodiment 310, wherein the second stimulus induces expression of the first sgRNA encoded by the writing plasmid.
Embodiment 313. The method of embodiment 310, wherein the second stimulus induces expression of the second sgRNA encoded by the writing plasmid.
Embodiment 314. The method of any one of embodiments 309-313, wherein the second stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.
Embodiment 315. The method of embodiment 314, wherein the cell is contacted with the first stimulus and the second stimulus simultaneously.
Embodiment 316. The method of embodiment 314, wherein the cell is contacted with the first stimulus and the second stimulus sequentially.
Embodiment 317. The method of any one of embodiments 309-316, wherein the first stimulus induces expression of the napDNAbp encoded by the writing plasmid and the second stimulus induces expression of an sgRNA encoded by the writing plasmid, and wherein both stimuli are required for sgRNA association with the napDNAbp.
Embodiment 318. The method of embodiment 317, wherein the napDNAbp introduces a DNA double-strand break in the target sequence of the recording plasmid complementary to the sgRNA, thereby reducing the amount of the recording plasmid.
Embodiment 319. The method of embodiment 317, wherein the napDNAbp introduces a DNA double-strand break in the target sequence of the recording plasmid complementary to the sgRNA, thereby reducing the amount of functional reporter protein expressed in the cell.
Embodiment 320. The method of any one of embodiments 309-319, wherein the cell is contacted with the second stimulus at least once.
Embodiment 321. The method of embodiment 320, wherein the cell is contacted with the stimulus at least two, three, four, five, six, seven, eight, nine, or ten times.
Embodiment 322. A method for recording the presence and/or duration of a stimulus in an engineered cell, the method comprising:
  (i) providing an engineered cell comprising the cell data recorder system of any one of embodiments 193-197; and
  (ii) determining the percentage of base editing in a target sequence of the recording plasmid.
Embodiment 323. The method of embodiment 322, wherein the engineered cell is produced by the method of any one of embodiments 226-238.
Embodiment 324. The method of embodiment 322 or 323, wherein the cell data recorder system comprises (i) a fusion protein comprising an napDNAbp and a nucleic acid editing protein and (ii) an sgRNA complementary to the target sequence of the recording plasmid, wherein the sgRNA associates with the napDNAbp under conditions that induce the expression of the fusion protein and the sgRNA.
Embodiment 325. The method of embodiment 324, wherein the sgRNA is encoded by the writing plasmid, and wherein the nucleic acid sequence encoding the sgRNA is operably linked to a promoter.
Embodiment 326. The method of embodiment 324, wherein the napDNAbp is a dCas9 domain or a Cas9n domain.
Embodiment 327. The method of embodiment 324, wherein the nucleic acid editing protein is a deaminase domain.
Embodiment 328. The method of embodiment 324, wherein the target sequence is present in a reporter gene encoding a functional reporter protein.
Embodiment 329. The method of embodiment 328, wherein the functional reporter protein is a fluorescent protein.
Embodiment 330. The method of embodiment 329, wherein the fluorescent protein is EGFP.
Embodiment 331. The method of embodiment 322 or 323, wherein the percentage of base editing in the target sequence is determined using high-throughput sequencing of the amplified target sequence.
Embodiment 332. The method of any one of embodiments 322-331, wherein the cell is not contacted with a stimulus.
Embodiment 333. The method of any one of embodiments 322-331 further comprising contacting the cell with a stimulus, wherein the stimulus induces the expression of the fusion protein and/or the sgRNA encoded by the writing plasmid.
Embodiment 334. The method of embodiment 333, wherein the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.
Embodiment 335. The method of any one of embodiments 333-334, wherein the cell is contacted with the stimulus at least once.
Embodiment 336. The method of any one of embodiments 333-334, wherein the fusion protein edits a base in the target sequence.
Embodiment 337. The method of embodiment 336, wherein the fusion protein introduces a single C·G to T·A mutation in the strand of the target sequence not bound by the sgRNA associated with the napDNAbp.
Embodiment 338. The method of embodiment 336 or 337, wherein the base edit introduced by the fusion protein results in a reporter gene that does not encode a functional reporter protein, thereby reducing the amount of functional reporter protein expressed in the cell.
Embodiment 339. The method of any one of embodiments 333-338, wherein the cell is contacted with the stimulus at least two, three, four, five, six, seven, eight, nine, or ten times.
Embodiment 340. The method of any one of embodiments 322-339, wherein the determining of (ii) is performed one, two, three, four, five, six, seven, eight, nine, or ten times.
Embodiment 341. The method of any one of embodiments 322-340, further comprising (iv) comparing the percentage of base editing in the target sequence in the presence of the stimulus to the percentage of base editing in the absence of the stimulus.

Embodiment 342. The method of embodiment 341, wherein the percentage of base editing in the target sequence does not significantly change in the absence of the stimulus.

Embodiment 343. The method of embodiment 341, wherein a change in the percentage of base editing in the target sequence indicates the presence of the stimulus.

Embodiment 344. The method of embodiment 343, wherein the percentage of base editing in the target sequence increases in the presence of the stimulus.

Embodiment 345. The method of embodiment 344, wherein the percentage of base editing increases by at least 1%, 5%, 10%, 15%, 20%, 25%, 30%, 35%, 40%, 45%, 50%, 55%, 60%, 65%, 70%, 75%, 80%, or 85% in the presence of the stimulus.

Embodiment 346. The method of embodiment 344, wherein the percentage of base editing increases by at least 2-fold, 3-fold, 4-fold, or 5-fold in the presence of the stimulus.

Embodiment 347. The method of any one of embodiments 341-346, wherein the comparing of (iv) is performed one, two, three, four, five, six, seven, eight, nine, or ten times.

Embodiment 348. The method of any one of embodiments 322-347, wherein the cell is exposed to a second stimulus, and wherein the second stimulus induces expression of the fusion protein and/or expression of an sgRNA encoded by the writing plasmid.

Embodiment 349. The method of embodiment 348, wherein the cell is exposed to a second stimulus, and wherein the second stimulus induces expression of the fusion protein the and/or expression of one or more of the sgRNAs encoded by the writing plasmid.

Embodiment 350. The method of embodiment 348 or 349, wherein the second stimulus induces expression of the napDNAbp, a first sgRNA, a second sgRNA, and/or a third sgRNA encoded by the writing plasmid.

Embodiment 351. The method of embodiment 348 or 349, wherein the second stimulus induces expression of the fusion protein encoded by the writing plasmid.

Embodiment 352. The method of embodiment 348 or 349, wherein the second stimulus induces expression of the first sgRNA encoded by the writing plasmid.

Embodiment 353. The method of embodiment 348 or 349, wherein the second stimulus induces expression of the second sgRNA encoded by the writing plasmid.

Embodiment 354. The method of embodiment 348 or 349, wherein the second stimulus induces expression of the third sgRNA encoded by the writing plasmid.

Embodiment 355. The method of any one of embodiments 348-354, wherein the second stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.

Embodiment 356. The method of embodiment 355, wherein the cell is contacted with the first stimulus and the second stimulus simultaneously.

Embodiment 357. The method of embodiment 355, wherein the cell is contacted with the first stimulus and the second stimulus sequentially.

Embodiment 358. The method of any one of embodiments 348-357, wherein the first stimulus induces expression of the fusion protein encoded by the writing plasmid and the second stimulus induces expression of an sgRNA encoded by the writing plasmid, and wherein both stimuli are required for sgRNA association with the napDNAbp of the fusion protein.

Embodiment 359. The method of any one of embodiments 322-358, wherein the cell is exposed to a third stimulus, and wherein the third stimulus induces expression of the fusion protein and/or expression of an sgRNA encoded by the writing plasmid.

Embodiment 360. The method of embodiment 359, wherein the first stimulus induces expression of the fusion protein encoded by the writing plasmid, the second stimulus induces expression of the first sgRNA encoded by the writing plasmid, and the third stimulus induces expression of the second sgRNA encoded by the writing plasmid.

Embodiment 361. The method of embodiment 359 or 360, wherein the fusion protein edits a base in the target sequence in response to a first stimulus and a second stimulus, thereby providing a new target sequence comprising a base edit.

Embodiment 362. The method of embodiment 361, wherein the fusion protein and edits a base in the new target strand in response to a third stimulus.

Embodiment 363. The method of embodiment 359, wherein the cell is contacted with the second and/or the third stimulus at least once.

Embodiment 364. The method of embodiment 363, wherein the cell is contacted with the second and/or the stimulus at least two, three, four, five, six, seven, eight, nine, or ten times.

Embodiment 365. A method for recording the presence and/or duration of a stimulus in an engineered cell, the method comprising:
(i) providing an engineered cell comprising the cell data recorder system of any one of embodiments 198-202; and
(ii) determining the percentage of base editing in a target sequence of the recording gene present in the genome of the cell.

Embodiment 366. The method of embodiment 365, wherein the engineered cell is produced by the method of any one of embodiments 239-256.

Embodiment 367. The method of embodiment 365 or 366, wherein the cell data recorder system comprises (i) a fusion protein comprising an napDNAbp and a nucleic acid editing protein and (ii) an sgRNA complementary to the target sequence of a recording gene, wherein the sgRNA associates with the napDNAbp under conditions that induce the expression of the fusion protein and the sgRNA.

Embodiment 368. The method of embodiment 367, wherein the sgRNA is expressed by the cell.

Embodiment 369. The method of embodiment 367, wherein the sgRNA is encoded by a plasmid.

Embodiment 370. The method of embodiment 369, wherein the sgRNA is encoded by the writing plasmid, and wherein the nucleic acid sequence encoding the sgRNA is operably linked to a promoter.

Embodiment 371. The method of embodiment 367, wherein the napDNAbp is a dCas9 domain or a Cas9n domain.

Embodiment 372. The method of embodiment 367, wherein the nucleic acid editing protein is a deaminase domain.

Embodiment 373. The method of embodiment 365, wherein the target sequence is present in a safe harbor locus of a gene in the genome of the cell.

Embodiment 374. The method of embodiment 373, wherein the safe harbor locus is a safe harbor locus of the CCR5 gene.

Embodiment 375. The method of embodiment 365 or 366, wherein the percentage of base editing in the target sequence is determined using high-throughput sequencing of the amplified target sequence.

Embodiment 376. The method of any one of embodiments 365-375, wherein the cell is not contacted with a stimulus.

Embodiment 377. The method of any one of embodiments 365-375 further comprising contacting the cell with a stimulus, wherein the stimulus induces the expression of the fusion protein and/or the sgRNA encoded by the writing plasmid or expressed by the cell.

Embodiment 378. The method of embodiment 377, wherein the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.

Embodiment 379. The method of any one of embodiments 377-378, wherein the cell is contacted with the stimulus at least once.

Embodiment 380. The method of any one of embodiments 377-379, wherein the fusion protein edits a base in the target sequence.

Embodiment 381. The method of embodiment 380, wherein the fusion protein introduces a single C·G to T·A mutation in the strand of the target sequence not bound by the sgRNA associated with the fusion protein.

Embodiment 382. The method of any one of embodiments 377-381, wherein the cell is contacted with the stimulus at least two, three, four, five, six, seven, eight, nine, or ten times.

Embodiment 383. The method of any one of embodiments 365-382, wherein the determining of (ii) is performed one, two, three, four, five, six, seven, eight, nine, or ten times.

Embodiment 384. The method of any one of embodiments 365-383, further comprising (iv) comparing the percentage of base editing in the target sequence in the presence of the stimulus to the percentage of base editing in the absence of the stimulus.

Embodiment 385. The method of embodiment 384, wherein the percentage of base editing in the target sequence does not significantly change in the absence of the stimulus.

Embodiment 386. The method of embodiment 384, wherein a change in the percentage of base editing in the target sequence indicates the presence of the stimulus.

Embodiment 387. The method of embodiment 386, wherein the percentage of base editing in the target sequence increases in the presence of the stimulus.

Embodiment 388. The method of embodiment 387, wherein the percentage of base editing increases by at least 1%, 5%, 10%, 15%, 20%, 25%, 30%, 35%, 40%, 45%, 50%, 55%, 60%, 65%, 70%, 75%, 80%, or 85% in the presence of the stimulus.

Embodiment 389. The method of embodiment 387, wherein the percentage of base editing increases by at least 2-fold, 3-fold, 4-fold, or 5-fold in the presence of the stimulus.

Embodiment 390. The method of any one of embodiments 384-389, wherein the comparing of (iv) is performed one, two, three, four, five, six, seven, eight, nine, or ten times.

Embodiment 391. The method of any one of embodiments 377-390, wherein the cell is contacted with a second stimulus.

Embodiment 392. The method of embodiment 391, wherein the second stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.

Embodiment 393. The method of any one of embodiments 391 or 392, wherein the cell is contacted with the second stimulus at least once.

Embodiment 394. The method of embodiment 393, wherein the cell is contacted with the second stimulus at least two, three, four, five, six, seven, eight, nine, or ten times.

TABLE 1

Final indel rates observed in CAMERA 1.2 and 1.3 after multiple rounds of recording and erasing.

| sample | treatment | Indel (%) |
|---|---|---|
| CAMERA 1.2 | reset-round 3-replicate #1 | 0.054 |
| CAMERA 1.2 | reset-round 3-replicate #2 | 0.013 |
| CAMERA 1.2 | reset-round 3-replicate #3 | 0.014 |
| CAMERA 1.3-36% R3 | aTc IPTG-treatment 4-repliate #1 | 0.022 |
| CAMERA 1.3-36% R3 | aTc IPTG-treatment 4-repliate #2 | 0.021 |
| CAMERA 1.3-36% R3 | aTc IPTG-treatment 4-repliate #3 | 0.023 |
| CAMERA 1.3-77% R3 | aTc rhamnose-treatment 3-repliate #1 | 0.022 |
| CAMERA 1.3-77% R3 | aTc rhamnose-treatment 3-repliate #2 | 0.026 |
| CAMERA 1.3-77% R3 | aTc rhamnose-treatment 3-repliate #3 | 0.029 |

TABLE 2

CAMERAs developed in this work.

| CAMERA | Recording plasmid | Writing plasmid | Readout | Functions |
|---|---|---|---|---|
| 1.0 | R1/R2 | 1.0.3 $P_{TetO}$-sd2U-Cas9 and $P_{Lac}$-sgRNA1 | EGFP fluorescence, R1:R2 ratio | Record the concentration and duration of aTc exposure |
| 1.1 | R1/R2 | 1.1 $P_{TetO}$-sd2U-Cas9 and $P_{LacO}$-sgRNA1 | EGFP fluorescence, R1:R2 ratio | Record the concentration and duration of aTc and IPTG exposure |

TABLE 2-continued

CAMERAs developed in this work.

| CAMERA | Recording plasmid | Writing plasmid | Readout | Functions |
|---|---|---|---|---|
| 1.2 | R3/R4 | 1.2 $P_{TetO}$-sd2U-Cas9 and $P_{LacO}$-sgRNA1 | EGFP fluorescence, R3:R4 ratio | Record the concentration and duration of aTc and IPTG exposure, with erasing upon kanamycin treatment |
| 1.3 | R3/R4 | 1.3 $P_{TetO}$-sd2U-Cas9, $P_{LacO}$-sgRNA1, and $P_{Rha}$-sgRNA2 | EGFP fluorescence, R3:R4 ratio | Record the concentration and duration of aTc and IPTG exposure, with erasing by rhamnose treatment |
| 2.0 | R1 | 2.0 $P_{TetO}$-SD8-BE2 and $P_{Lac}$-sgRNA1 | G:G to T:A editing at position 166 of EGFP | Record the concentration and duration of aTc exposure |
| 2.1 | R1 | 2.1 $P_{TetO}$-SD8-BE2 and $P_{LacO}$-sgRNA1 | G:G to T:A editing at position 166 of EGFP | Record the concentration and duration of aTc and IPTG exposure |
| 2.2 | R1 | 2.2 $P_{TetO}$-SD8-BE2 and $P_{BAD}$-sgRNA3 | G:G to T:A editing at position 186 of EGFP | Record the concentration and duration of aTc and arabinose exposure |
| 2.3 | R1 | 2.3 $P_{TetO}$-SD8-BE2 and $P_{Rha}$-sgRNA4 | G:G to T:A editing at position 195 of EGFP | Record the concentration and duration of aTc and rhamnose exposure |
| 2.4 | R1 | 2.4 $P_{TetO}$-SD8-BE2, $P_{LacO}$-sgRNA1, $P_{BAD}$-sgRNA3, and $P_{Rha}$-sgRNA4 | G:G to T:A editing at positions 166, 186 and 195 of EGFP | Record exposure to aTc, IPTG, arabinose, and rhamnose in an independent manner |
| 2.5 | R5 | 2.5 $P_{TetO}$-SD8-BE2, $P_{BAD}$-sgRNA5, and $P_{Rha}$-sgRNA6 | G:G to T:A editing at at positions 129, 205-207 and 216 of EGFP | Record the presence of aTc/arabinose and aTc/rhamnose in an order-dependent manner |
| 2.6 | R1 | 2.6 $P_{TetO}$-SD8-BE2 and $P_{PSP}$-sgRNA1 | G:G to T:A editing at position 166 of EGFP | Record phage infection |
| 2.7 | R6 | 2.7 $P_R$-RBS-BE2, $P_{FixK2}$-cI, $P_{LacIq}$-YF1/FixJ, and $P_{LacO}$-sgRNA1 | G:G to T:A editing at position 166 of EGFP | Record light exposure |
| 2m.0 | CCR5 (genomic loci) | 2m.0 CMV-BE3 U6-sgRNA A U6-sgRNA B U6-sgRNA C | G:G to T:A editing at positions 378, 422 and 443 of CCR5 | Multiplexed recording using three individual guide RNAs |
| 2m.1 | CCR5 (genomic loci) | 2m.1 TRE3G-BE3 CMV-Tet3G U6-sgRNA B | G:G to T:A editing at position 422 of CCR5 | Record the presence of doxycycline |
| 2m.2 | CCR5 (genomic loci) | 2m.2 CMV-BE3 UBC-TetR-P2A-LacI U6$_{LacI}$-sgRNA A H1$_{TetR}$-sgRNA B | G:G to T:A editing at positions 378 and 422 of CCR5 | Record the presence of doxycycline and IPTG |
| 2m.3.1 | CCR5 (genomic loci) | 2m.3.1 (TCF/LEF)$_7$-BE3 U6-sgRNA B | G:G to T:A editing at position 422 of CCR5 | Record Wnt signaling |
| 2m.3.2 | CCR5 (genomic loci) | 2m.3.2 (TCF/LEF)$_7$-BE3-P2A-Luc U6-sgRNA B | G:G to T:A editing at position 422 of CCR5 | Record Wnt signaling |

TABLE 3

Summary of plasmid constructs.

| Name | Class | Antibiotic Resistance | Origin of Replication | Promoter (-RBS) | Gene |
|---|---|---|---|---|---|
| pWT004a | R1 | Carb | pUC | $P_{BAD}$ | EGFP |
| pWT004b | R2 | Carb | pUC | $P_{BAD}$ | EGFP-151TGA |
| pWT018a | R3 | ΔChlo-Kan | pUC | $P_{BAD}$ | EGFP |
| pWT018e | R4 | Chlo-ΔKan | pUC | $P_{BAD}$ | EGFP-151TGA |
| pWT004j | R5 | Carb | pUC | $P_{BAD}$ | EGFP-115-135insertion, T206G |
| pWT009d | R6 | Carb | RSF1030 | $P_{BAD}$ | EGFP |
| pWT007a | W1.0.1 | Spect | SC101 | $P_{TetO}$-SD8<br>$P_{Lac}$ | Cas9<br>sgRNA1 |
| pWT007g | W1.0.2 | Spect | SC101 | $P_{TetO}$-sd2<br>$P_{Lac}$ | Cas9<br>sgRNA1 |
| pWT007f | W1.0.3 | Spect | SC101 | $P_{TetO}$-sd2U<br>$P_{Lac}$ | Cas9<br>sgRNA1 |
| pWT007h | W1.0.1c | Spect | SC101 | $P_{TetO}$-SD8<br>$P_{Lac}$ | Cas9<br>sgRNA(con.) |
| pWT019a | W1.1 | Spect | SC101 | $P_{TetO}$-sd2U<br>$P_{LacO}$ | Cas9<br>sgRNA1 |
| pWT019b | W1.2 | Spect | SC101 | $P_{TetO}$-sd2U<br>$P_{LacO}$<br>$P_{Rha}$ | Cas9<br>sgRNA1<br>sgRNA2 (sgRNA1-G19T-G20C) |
| pWT021a | W2.0 | Spect | SC101 | $P_{TetO}$-SD8<br>$P_{Lac}$ | BE2<br>sgRNA1 |
| pWT037a | W2.1 | Spect | SC101 | $P_{TetO}$-SD8<br>$P_{LacO}$ | BE2<br>sgRNA1 |
| pWT046a | W2.2<br>W2.4-1 | Spect | SC101 | $P_{TetO}$-SD8<br>$P_{BAD}$ | BE2<br>sgRNA3 |
| pWT046b | W2.3 | Spect | SC101 | $P_{TetO}$-SD8<br>$P_{Rha}$ | BE2<br>sgRNA4 |
| pWT050a | W2.4-2 | Chlo | CloDF13 | $P_{LacO}$<br>$P_{Rha}$ | sgRNA1<br>sgRNA4 |
| pWT046e | W2.5-1 | Spect | SC101 | $P_{TetO}$-SD8<br>$P_{BAD}$ | BE2<br>sgRNA5 (sgRNA3-A8C) |
| pWT050d | W2.5-2 | Chlo | CloDF13 | $P_{LacO}$<br>$P_{Rha}$ | sgRNA1<br>sgRNA6-(sgRNA4-C16T-C18T) |
| pWT045c | W2.6 | Spect | SC101 | $P_{TetO}$-SD8<br>$P_{PSP}$ | BE2<br>sgRNA1 |
| pWT047c | W2.7-1 | Spect | SC101 | $P_R$-sd5<br>$P_{Lac}$ | BE2<br>sgRNA1 |
| pDawn | W2.7-2 | Kan | CloE1 | $P_R$<br>$P_{FixK2}$<br>$P_{LacIq}$ | cI<br>YF1-FixJ |
| pACK129 | W2m.0-1<br>W2m.2-1 | Carb | CloE1 | CMV | BE3 |
| pWT060b | W2m.0-2 | Carb | CloE1 | U6 | sgRNA A(CCR5) |
| pWT060e | W2m.0-3<br>W2m.1-2<br>W2m.3-2 | Carb | CloE1 | U6 | sgRNA B(CCR5) |
| pWT060j | W2m.0-4 | Carb | CloE1 | U6 | sgRNA C(CCR5) |
| pWT063a | W2m.1-1 | Carb | CloE1 | $P_{TRE3G}$ | BE3 |
| pWT062a | W2m.2-2 | Carb | CloE1 | UBC | TetR-P2A-LacI |
| pWT062e | W2m.2-3 | Carb | CloE1 | $U6_{LacI}$ | sgRNA A |
| pWT062d | W2m.2-4 | Carb | CloE1 | $H1_{TetR}$ | sgRNA B |
| pWT065a | W2m.3.1-1 | Carb | CloE1 | (TCF/LEF)$_7$ | BE3 |
| pWT065c | W2m.3.2-1 | Carb | CloE1 | (TCF/LEF)$_7$ | BE3-P2A-Luc |

TABLE 4

Genotypes of bacterial strains used.

| Strain | Genotype |
|---|---|
| S1030 | F'proA+B+ Δ(lacIZY) zzf::Tn10(TetR) lacIQ1PN25-tetR luxCDE/endA1 recA1 galE15 galK16 nupG rpsL(StrR) ΔlacIZYA araD139 Δ(ara, leu)7697 mcrA Δ(mrr-hsdRMS-mcrBC) proBA::pir116 araE201 ΔrpoZ Δflu ΔcsgABCDEFG ΔpgaC λ− |

TABLE 4-continued

Genotypes of bacterial strains used.

| Strain | Genotype |
| --- | --- |
| S2063 | F'proA+B+ Δ(lacIZY) zzf::Tn10 lacIQ1 PN25-tetR luxCDE Ppsp(AR2) lacZ luxR Plux groESL/endA1 recA1 galE15 galK16 nupG rpsL ΔlacIZYA araD139 Δ(ara, leu)7697 mcrA Δ(mrr-hsdRMS-mcrBC) proBA::pir116 araE201 ΔrpoZ Δflu ΔcsgABCDEFG ΔpgaC ΔpspBC λ– |

TABLE 5

Spacer sequences of guide RNAs used in this work. Base editing target sites are underlined. Mutated sites of modified EGFP genes in different recording plasmids are in bold.

| sgRNA | Spacer sequence |
| --- | --- |
| sgRNA-1 | GGGCACGGGCAGCTTGCCGG (SEQ ID NO: 701) |
| sgRNA-2 | GGGCACGGGCAGCTTGCCTC (SEQ ID NO: 702) |
| sgRNA-3 | GTGGTCACGAGGGTGGGCCA (SEQ ID NO: 703) |
| sgRNA-4 | GTAGGTCAGGGTGGTCACGA (SEQ ID NO: 704) |
| sgRNA-5 | GTGGTCCCGAGGGTGGGCCA (SEQ ID NO: 705) |
| sgRNA-6 | GTAGGTCAGGGTGGTAAAGA (SEQ ID NO: 706) |
| sgRNA-A (CCR5) | GGTACCTATCGATTGTCAGG (SEQ ID NO: 707) |
| sgRNA-B (CCR5) | CAGGACGGTCACCTTTGGGG (SEQ ID NO: 708) |
| sgRNA-C (CCR5) | GGTGACAAGTGTGATCACTT (SEQ ID NO: 709) |

TABLE 6

Primer sequences of high-throughput sequencing used in this work. Sequences that anneal to the templates are in italic.

| primer | sequence |
| --- | --- |
| EGFP_adapter_F_1 | ACACTCTTTCCCTACACGACGCTCTTCCGATCT*CGGCCACAAGTTCAGCG* (SEQ ID NO: 710) |
| EGFP_adapter_F_2 | ACACTCTTTCCCTACACGACGCTCTTCCGATCTNNNN*CGGCCACAAGTTCAGCG* (SEQ ID NO: 711) |
| EGFP_adapter_F_3 | ACACTCTTTCCCTACACGACGCTCTTCCGATCTNNNN*ACGGCCACAAGTTCAGCG* (SEQ ID NO: 712) |
| EGFP_adapter_F_4 | ACACTCTTTCCCTACACGACGCTCTTCCGATCTNNNN*ACGGCGACGTAAACGG* (SEQ ID NO: 713) |
| EGFP_adapter_R_1 | TGGAGTTCAGACGTGTGCTCTTCCGATCT*CTTCGGGCATGGCGG* (SEQ ID NO: 714) |
| EGFP_adapter_R_2 | TGGAGTTCAGACGTGTGCTCTTCCGATCT*GCTGCTTCATGTGGTCG* (SEQ ID NO: 715) |
| EGFP_amplicon_F (single cell PCR) | *ACGGCGACGTAAACGG* (SEQ ID NO: 716) |
| EGFP_amplicon_R (single cell PCR) | *GCTGCTTCATGTGGTCG* (SEQ ID NO: 717) |
| CCR5_adapter_F_1 | ACACTCTTTCCCTACACGACGCTCTTCCGATCTNNNN*CTGTCCCCTTCTGGGC* (SEQ ID NO: 718) |
| CCR5_adapter_F_2 | ACACTCTTTCCCTACACGACGCTCTTCCGATCTNNNN*TACTGTCCCCTTCTGGGC* (SEQ ID NO: 719) |
| CCR5_adapter_F_3 | ACACTCTTTCCCTACACGACGCTCTTCCGATCTNNNN*GTCGTCCATGCTGTGTTTGC* (SEQ ID NO: 720) |
| CCR5_adapter_R | TGGAGTTCAGACGTGTGCTCTTCCGATCT*GGAAAATGAGAGCTGCAGG* (SEQ ID NO: 721) |

TABLE 7

Additional exemplary bacterial promoter sequences.

| Promoter | Inducer | Sequence |
| --- | --- | --- |
| Lac | lactose/IPTG | TTTACACTTTATGCTTCCGGCTCGTATGTT |
| LacO | lactose/IPTG | TTGTGAGCGGATAACAA |
| LacUV5 | lactose/IPTG | TTTACACTTTATGCTTCCGGCTCGTATAATG |
| Trp | Tryptophan starvation or addition of B-indoleacrylic acid | TTGACAATTAATCATCGAACTAGTTAACT |
| Tac (hybrid of trp and lacUV5 promoters) | lactose/IPTG | TTGACAATTAATCATCGGCTCGTATAATG |
| Trc (hybrid of trp and lacUV5 promoters) | lactose/IPTG | TTGACAATTAATCATCCGGCTCGTATAATG |
| TetO | Anhydrotetracycline (aTc) | TCCCTATCAGTGATAGAGA |
| TetA | Anhydrotetracycline (aTc) | TTGACACTCTATCATTGATAGAGTTATTTT |
| T7 | thermal, requires T7 RNA polymerase | TAATACGACTCACTATAGG |
| T7-lac operator | IPTG | The T7lac promoter contains a 25 bp lac operator sequence immediately downstream from the 17 bp promoter region. |
| T3-lac operator | IPTG | AATTAACCCTCACTAAAGG and a 25 bp lac operator sequence immediately downstream |
| T5-lac operator | IPTG | TCATAAAAAATTTATTTGCTTTGTGAGCGG ATAACAATTATAATA (with embedded LacO) |
| araBAD | arabinose | AAAGCCATGACAAAAACGCGTAACAAAAG TGTCTATAATCACGGCAGAAAAGTCCACAT TGATTATTTGCACGGCGTCACACTTTGCTAT GCCATAGCATTTTTATCCATAAGATTAGCG GATCCTACCTGACGCTTTTTATCGCAACTCT CTACTGTTTCTCCAT |
| pRha | rhamnose | ATTGCGAGCTCTATTCCGTGATAATTTGG |
| rhaBAD | rhamnose | CACCACAATTCAGCAAATTGTGAACATCAT CACGTTCATCTTTCCCTGGTTGCCAATGGCC CATTTTCCTGTCAGTAACGAGAAGGTCGCG AATTCAGGCGCTTTTTAGACTGGTCGTA |
| lambda pL | thermal/heat inducible | TATCTCTGGCGGTGTTGACATAAATACCAC TGGCGGTGATACTGAGCACATCAGCAGGA |
| lambda pR | thermal/heat inducible | TAACACCGTGCGTGTTGACTGTTTTACCTCT GGCGGTGATAATGGTTGCATGTACTAAG |
| PesaR (contains luciferase) | 3OC6HSL (Quorum sensing molecule) | GCAGATTGAGTAACCGTGAATGTTTGTACA AATGTTTCAAAGATGTTACTATGAGTGTCC CGGCCAGCATCACTTTATATTTTGTGACGTC TGGCCGGACGTTTTCCCTAGTGTTGGCTGTT TTAGCGACCTGGCCGTACAGGTCAGGTTTT TTTTTACCGCTAAACAACTGAAGCCATTGT AACCTCTGAATGATTCATTGTAAGTTACTCT TAAGTATCATCTTGCCTGTACTATAGTGCAG GTTAAGTCCACGTTAAGTAAAAGAAGCAGC |
| phoA | phosphate starvation | GCTTTGTTTTTATTTTTAATGTATTTGTACA TGGAGAAAATAAA |
| recA | nalidixic acid | ACTTGATACTGTATGAGCATACAGTATAAT TGCTTCAACAGAACATATTGACTATCCGGT ATTACCCGGC |
| SP6 | Constitutive, but requires SP6 RNA polymerase | ATTTAGGTGACACTATAGA |

TABLE 7-continued

Additional exemplary bacterial promoter sequences.

| Promoter | Inducer | Sequence |
|---|---|---|
| Ptac | Regulated like Lac promoter | |
| pL | Temperature regulatable, often paired with temperature sensitive cI857 repressor | |

TABLE 8

Additional exemplary mammalian promoter sequences.

| Promoter | Inducer | Sequence |
|---|---|---|
| LacO | lactose/IPTG | TTGTGAGCGGATAACAA |
| TRE (tetracycline response element) | tetracycline (Tc) or derivatives | 7 repeats of TetO seperated by spacer sequences |
| tTA (tetracyline-controlled transactivator) (Tet-Off) | tetracycline (Tc) or derivatives, doxycycline | fusion of tetR (tetracycline repressor) found in E. coli, with the activation domain of VP16 found in Herpes Simplex Virus |
| rtTA (reverse tetracycline-controlled transactivator) (Tet-On) | doxycycline | fusion of rtetR (reverse tetracycline repressor) found in E. coli, with the activation domain of VP16 found in Herpes Simplex Virus |
| CMV promoters (i.e. human cytomegalovirus immediate-early enchancer and promoter) | constitutively active, but also used in inducible mammalian systems in which it is induced by tetracycline, ecdysone, or IPTG | GTGATGCGGTTTTGGCAGTACATCAAT GGGCGTGGATAGCGGTTTGACTCACG GGGATTTCCAAGTCTCCACCCCATTGA CGTCAATGGGAGTTTGTTTTGGCACCA AAATCAACGGGACTTTCCAAAATGTCG TAACAACTCCGCCCCATTGACGCAAAT GGGCGGTAGGCGTGTACGGTGGGAGG TCTATATAAGCAGAGCT |
| SV40 (simian virus 40) (enhancer and early promoter) | constitutive (not inducible) | GGTGTGGAAAGTCCCCAGGCTCCCCA GCAGGCAGAAGTATGCAAAGCATGCA TCTCAATTAGTCAGCAACCAGGTGTGG AAAGTCCCCAGGCTCCCCAGCAGGCA GAAGTATGCAAAGCATGCATCTCAATT AGTCAGCAACCATAGTCCCGCCCCTAA CTCCGCCCATCCCGCCCCTAACTCCGC CCAGTTCCGCCCATTCTCCGCCCCATG GCTGACTAATTTTTTTTATTTATGCAGA GGCCGAGGCCGCCTCGGCCTCTGAGCT ATTCCAGAAGTAGTGAGGAGGCTTTTT TGGAGGCCTAGGCTTTTGCAAA |
| EF-1 alpha (elongation factor, non-viral) | constitutive (not inducible) | GGCTCCGGTGCCCGTCAGTGGGCAGA GCGCACATCGCCCACAGTCCCCGAGA AGTTGGGGGGAGGGGTCGGCAATTGA ACCGGTGCCTAGAGAAGGTGGCGCGG GGTAAACTGGGAAAGTGATGTCGTGT ACTGGCTCCGCCTTTTTCCCGAGGGTG GGGGAGAACCGTATATAAGTGCAGTA GTCGCCGTGAACGTTCTTTTTCGCAAC GGGTTTGCCGCCAGAACACAGGTAAG TGCCGTGTGTGGTTCCCGCGGGCCTGG CCTCTTTACGGGTTATGGCCCTTGCGT GCCTTGAATTACTTCCACCTGGCTGCA GTACGTGATTCTTGATCCCGAGCTTCG GGTTGGAAGTGGGTGGGAGAGTTCGA GGCCTTGCGCTTAAGGAGCCCCTTCGC CTCGTGCTTGAGTTGAGGCCTGGCCTG GGCGCTGGGGCCGCCGCGTGCGAATC TGGTGGCACCTTCGCGCCTGTCTCGCT GCTTTCGATAAGTCTCTAGCCATTTAA AATTTTTGATGACCTGCTGCGACGCTT |

TABLE 8-continued

Additional exemplary mammalian promoter sequences.

| Promoter | Inducer | Sequence |
|---|---|---|
| | | TTTTTCTGGCAAGATAGTCTTGTAAAT GCGGGCCAAGATCTGCACACTGGTATT TCGGTTTTTGGGGCCGCGGGCGGCGAC GGGGCCCGTGCGTCCCAGCGCACATGT TCGGCGAGGCGGGGCCTGCGAGCGCG GCCACCGAGAATCGGACGGGGGTAGT CTCAAGCTGGCCGGCCTGCTCTGGTGC CTGGCCTCGCGCCGCCGTGTATCGCCC CGCCCTGGGCGGCAAGGCTGGCCCGG TCGGCACCAGTTGCGTGAGCGGAAAG ATGGCCGCTTCCCGGCCCTGCTGCAGG GAGCTCAAAATGGAGGACGCGGCGCT CGGGAGAGCGGGCGGGTGAGTCACCC ACACAAAGGAAAAGGGCCTTTCCGTC CTCAGCCGTCGCTTCATGTGACTCCAC GGAGTACCGGGCGCCGTCCAGGCACC TCGATTAGTTCTCGAGCTTTTGGAGTA CGTCGTCTTTAGGTTGGGGGGAGGGGT TTTATGCGATGGAGTTTCCCCACACTG AGTGGGTGGAGACTGAAGTTAGGCCA GCTTGGCACTTGATGTAATTCTCCTTG GAATTTGCCCTTTTTGAGTTTGGATCTT GGTTCATTCTCAAGCCTCAGACAGTGG TTCAAAGTTTTTTTCTTCCATTTCAGGT GTCGTGA |
| PGK1 (human or mouse) | Constitutive not inducible) | |
| Ubc | Constitutive (not inducible) | Derived from ubiquitin C gene, e.g,, human ubiquitin C |
| Ubi | Constitutive (not inducible) | Promoter from maize ubiquitin gene |
| Human beta actin | Constitutive (not inducible) | |
| CAG | Constitutive (not inducible) | |
| Ac5 | Constitutive (not inducible) | From *Drosophila* Actin 5c gene |
| Polyhedrin | Constitutive (not inducible) | From baculovirus |
| UAS (*Drosophila*) | Inducible by presence of Gal4 gene | |
| CID-based | rapamycin | |
| CaMKIIa | Inducible by Ca2+/calmodulin | |
| GAL1, GAL10 | Inducible with galactose, repressible by glucose | |
| GDS (aka TDH3 or GAPDH) | Constitutive (not inducible) | Promoter from glyceraldehyde-3-phosphate dehydrogenase |
| TEF1 | Constitutive (not inducible) | Analogous to mammalian EF1a promoter |
| ADH1 | Repressed by ethanol | Yeast promoter for alcohol dehydrogenase |
| CaMV35S | Constitutive (not inducible) | |
| ecdysone-based | ecdysone | |
| estrogen and progesterone-based | estrogen or progesterone hormone | |

TABLE 9 sgRNA sequences used herein.

sgRNA 1:
GGGCACGGGCAGCTTGCCGGGTTTTAGAGCTAGAAATAGCAAGTTAAAAT
AAGGCTAGTCCGTTATCAACTTGAAAAAGTGGCACCGAGTCGGTGCTTTTT
TT sgRNA 2:
GGGCACGGGCAGCTTGCCTCGTTTTAGAGCTAGAAATAGCAAGTTAAAAT
AAGGCTAGTCCGTTATCAACTTGAAAAAGTGGCACCGAGTCGGTGCTTTTT
TT sgRNA 3:
GTGGTCACGAGGGTGGGCCAGTTTTAGAGCTAGAAATAGCAAGTTAAAAT
AAGGCTAGTCCGTTATCAACTTGAAAAAGTGGCACCGAGTCGGTGCTTTTT
TT sgRNA 4:
GTAGGTCAGGGTGGTCACGAGTTTTAGAGCTAGAAATAGCAAGTTAAAAT
AAGGCTAGTCCGTTATCAACTTGAAAAAGTGGCACCGAGTCGGTGCTTTTT
TT sgRNA 5:
GTGGTCCCGAGGGTGGGCCAGTTTTAGAGCTAGAAATAGCAAGTTAAAAT
AAGGCTAGTCCGTTATCAACTTGAAAAAGTGGCACCGAGTCGGTGCTTTTT
TT

TABLE 9-continued sgRNA sequences used herein.

sgRNA 6:
GTAGGTCAGGGTGGTAAAGAGTTTTAGAGCTAGAAATAGCAAGTTAAAAT
AAGGCTAGTCCGTTATCAACTTGAAAAAGTGGCACCGAGTCGGTGCTTTTT
TT sgRNA A:
GGTACCTATCGATTGTCAGGGTTTTAGAGCTAGAAATAGCAAGTTAAAAT
AAGGCTAGTCCGTTATCAACTTGAAAAAGTGGCACCGAGTCGGTGCTTTTT
TT sgRNA B:
CAGGACGGTCACCTTTGGGGGTTTTAGAGCTAGAAATAGCAAGTTAAAAT
AAGGCTAGTCCGTTATCAACTTGAAAAAGTGGCACCGAGTCGGTGCTTTTT
TT sgRNA C:
GGTGACAAGTGTGATCACTTGTTTTAGAGCTAGAAATAGCAAGTTAAAAT
AAGGCTAGTCCGTTATCAACTTGAAAAAGTGGCACCGAGTCGGTGCTTTTT
TT sgRNA D:
CACACTTGTCACCACCCCAAGTTTTAGAGCTAGAAATAGCAAGTTAAAAT
AAGGCTAGTCCGTTATCAACTTGAAAAAGTGGCACCGAGTCGGTGCTTTTT
TT

TABLE 10

Additional exemplary promoters for recording of mammalian pathways

| pathway | Triggering molecule | concentration | Promoter sequence |
|---|---|---|---|
| NFκB | TNFα | 0.2-20 ng/mL | GGGACTTTCCGGGACTTTCCGGGACTTTCCGGG ACTTTCCGGGACTTTCCGGGACTTTCCAAGCTT AGACACTAGAGGGTATATAATGGAAGCTCGACT TCCAG |
| CREB | foskolin | 5-100 μM | GCACCAGACAGTGACGTCAGCTGCCAGATCCCA TGGCCGTCATACTGTGACGTCTTTCAGACACCCC ATTGACGTCAATGGGAGAACAGATAAGCTTAGA CACTAGAGGGTATATAATGGAAGCTCGACTTCC AG |
| SMAD | TGFβ | 10-25 ng/mL | AGCCAGACAAAGCCAGACAAAAGCCAGACAAA GCCAGACAAAGCCAGACAAAGCCAGACAAAA GCCAGACAAAGCCAGACAAAAGCCAGACAAAG CCAGACAAAGCCAGACAAAGCCAGACAAAAG CTTAGACACTAGAGGGTATATAATGGAAGCTCG ACTTCCAG |
| C/EBP | LiCl | 10-20 mM | ATTGCGCAATATTGCGCAATCATTGCGCAATATT GCGCAATCAAGCTTAGACACTAGAGGGTATATA ATGGAAGCTCGACTTCCAG |
| SRF | PMA: 12-myristate 13-acetate | 10 ng/mL | CAGGATGTCCATATTAGGACACAGGATGTCCAT ATTAGGACACAGGATGTCCATATTAGGACACAG GATGTCCATATTAGGACACAGGATGTCCATATTA GGACACAGGATGTCCATATTAGGACAAAGCTTA GACACTAGAGGGTATATAATGGAAGCTCGACTT CCAG |
| NFAT | PMA | 10 ng/mL | CGGAGGAAAAACTGTTTCATACAGAAGGCGTGG AGGAAAAACTGTTTCATACAGAAGGCGTGGAGG AAAAACTGTTTCATACAGAAGGCGTAGATCTAG ACTCTAGAGGGTATATAATGGAAGCTCGAATTC CAG |
| GR | dexa-methasone | 10 nM-1 μM | AGAACAAAATGTACCGGTACATTTTGTTCTAAGC TTAGACACTAGAGGGTATATAATGGAAGCTCGA CTTCCAG |

TABLE 10-continued

Additional exemplary promoters for recording of mammalian pathways

| pathway | Triggering molecule | concentration | Promoter sequence |
|---|---|---|---|
| XRE | TCDD: 2,3,7,8-Tetra-chlorodi-benzodioxin | 0.1-1 nM | TGAGTTCTCACGCTAGCAGATTGAGTTCTCACGC TAGCAGATTGAGTTCTCACGCTAGCAGATTGAGT TCTCACGCTAGCAGATTGAGTTCTCACGCTAGCA GATTGAGTTCTCACGCTAGCAGATAAGCTTAGAC ACTAGAGGGTATATAATGGAAGCTCGACTTCCA G |
| MAPK/ Jnk | PMA | 0.5-10 ng/mL | CTGACTCAGCCTGAGTCAGCACTGACTCAGCCTG AGTCAGCACTGACTCAGCCTGAGTCAGCAAGCT TAGACACTAGAGGGTATATAATGGAAGCTCGAC TTCCAG |
| IRF1 | interferon γ | 1-100 ng/mL | GGAAGCGAAAATGAAATTGACTGGAAGCGAAA ATGAAATTGACTGGAAGCGAAAATGAAATTGAC TGGAAGCGAAAATGAAATTGACTGGAAGCGAAA ATGAAATTGACTGGAAGCGAAAATGAAATTGAC TAAGCTTAGACACTAGAGGGTATATAATGGAAG CTCGACTTCCAG |
| STAT1/ 2 | interferon α | 10-1000 U/mL | TAGTTTCACTTTCCCTAGTTTCACTTTCCCTAGTT TCACTTTCCCTAGTTTCACTTTCCCTAGTTTCACT TTCCCTAGTTTCACTTTCCCAAGCTTAGACACTA GAGGGTATATAATGGAAGCTCGACTTCCAG |
| E2F | EGF | 1 µg/mL | TTTCGCGGGAAATTTCGCGGGAAATTTCGCGGG AAATTTCGCGGGAAATTTCGCGGGAAATTTCGC GGGAAAAAGCTTAGACACTAGAGGGTATATAAT GGAAGCTCGACTTCCAG |
| HSF | 17-AAG | 1 µM | GAACGTTCCCGAAGAACGTTCCCGAAGAACGTT CCCGAAGAACGTTCCCGAAGAACGTTCCCGAAG AACGTTCCCGAAGAACGTTCCCGAAGAACGTTC CCGAAGAACGTTCCCGAAAAGCTTAGACACTAG AGGGTATATAATGGAAGCTCGACTTCCAG |
| GATA | PMA | 10-100 ng/mL | GGCATTCTCTATCTGATTGTTGGCATTCTCTATCT GATTGTTGGCATTCTCTATCTGATTGTTGGCATTC TCTATCTGATTGTTGGCATTCTCTATCTGATTGTT GGCATTCTCTATCTGATTGTTAAGCTTAGACACT AGAGGGTATATAATGGAAGCTCGACTTCCAG |
| ATF6 | tunicamycin | 200 ng/mL-2 µg/mL | CTCGAGACAGGTGCTGACGTGGCATTCCTCGAG ACAGGTGCTGACGTGGCATTCCTCGAGACAGGT GCTGACGTGGCATTCCTCGAGACAGGTGCTGAC GTGGCATTCCTCGAGACAGGTGCTGACGTGGCA TTCAAGCTTAGACACTAGAGGGTATATAATGGA AGCTCGACTTCCAG |
| CBF/ NF-Y/YY1 | tunicamycin | 200 ng/mL-2 µg/mL | CCTTCACCAATCGGCGGCCTCCACGACGGCCTTC ACCAATCGGCGGCCTCCACGACGGCCTTCACCA ATCGGCGGCCTCCACGACGGCCTTCACCAATCG GCGGCCTCCACGACGGCCTTCACCAATCGGCGG CCTCCACGACGGAAGCTTAGACACTAGAGGGTA TATAATGGAAGCTCGACTTCCAG |
| RAR | Tretinoin | 1-10 µM | AGGTCACCAGGAGGTCAAGGTCACCAGGAGGTC AAGGTCACCAGGAGGTCAAGGTCACCAGGAGGT CAAGGTCACCAGGAGGTCAAGGTCACCAGGAGG TCAAAGCTTAGACACTAGAGGGTATATAATGGA AGCTCGACTTCCAG |
| RXR | Tretinoin | 1-10 µM | AGGTCACAGGTCACAGGTCACAGGTCACAGGTC ACAGGTCACAGGTCACAGGTCACAGGTCACAGG TCACAGGTCACAGGTCACAAGCTTAGACACTAG AGGGTATATAATGGAAGCTCGACTTCCAG |
| VDR | calcitriol | 5-500 nM | GATCCACAAGGTTCACGAGGTTCACGTCCGGAT CCACAAGGTTCACGAGGTTCACGTCCGGATCCA CAAGGTTCACGAGGTTCACGTCCGGATCCACAA GGTTCACGAGGTTCACGTCCGAAGCTTAGACACT AGAGGGTATATAATGGAAGCTCGACTTCCAG |

TABLE 10-continued

Additional exemplary promoters for recording of mammalian pathways

| pathway | Triggering molecule | concentration | Promoter sequence |
|---|---|---|---|
| ARE | D,L-sulforaphane | 10 µM | TAGCTTGGAAATGACATTGCTAATGGTGACAAA GCAACTTTTAGCTTGGAAATGACATTGCTAATGG TGACAAAGCAACTTTCTCGAGGATATCAAGATCT GGCCTCGGCGGCCAAGCTTAGACACTAGAGGGT ATATAATGGAAGCTCGACTTCCAG |
| STAT3 | IL-6 | 5-150 ng/mL | GTCGACATTTCCCGTAAATCGTCGAGTCGACATT TCCCGTAAATCGTCGAGTCGACATTTCCCGTAAA TCGTCGAGTCGACATTTCCCGTAAATCGTCGAGT CGACATTTCCCGTAAATCGTCGAAAGCTTAGACA CTAGAGGGTATATAATGGAAGCTCGACTTCCAG |

Equivalents and Scope

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present invention, as defined in the following claims.

REFERENCES

1. J. Shendure, H. Ji, Next-generation DNA sequencing. Nat. Biotechnol. 26, 1135-1145 (2008).
2. J. M. Heather, B. Chain, The sequence of sequencers: The history of sequencing DNA. Genomics 107, 1-8 (2016).
3. O. Purcell, T. K. Lu, Synthetic analog and digital circuits for cellular computation and memory. Curr. Opin. Biotechnol. 29, 146-155 (2014).
4. M. C. Inniss, P. A. Silver, Building synthetic memory. Curr. Biol. 23, R812-816 (2013).
5. A. E. Friedland et al., Synthetic gene networks that count. Science 324, 1199-1202 (2009).
6. J. Bonnet, P. Subsoontorn, D. Endy, Rewritable digital data storage in live cells via engineered control of recombination directionality. Proc. Natl. Acad. Sci. U.S.A 109, 8884-8889 (2012).
7. L. Yang et al., Permanent genetic memory with >1-byte capacity. Nat. Methods 11, 1261-1266 (2014).
8. F. Farzadfard, T. K. Lu, Synthetic biology. Genomically encoded analog memory with precise in vivo DNA writing in living cell populations. Science 346, 1256272 (2014).
9. M. Jinek et al., A programmable dual-RNA-guided DNA endonuclease in adaptive bacterial immunity. Science 337, 816-821 (2012).
10. J. A. Doudna, E. Charpentier, Genome editing. The new frontier of genome engineering with CRISPR-Cas9. Science 346, 1258096 (2014).
11. L. Cong et al., Multiplex genome engineering using CRISPR/Cas systems. Science 339, 819-823 (2013).

12. A. C. Komor, Y. B. Kim, M. S. Packer, J. A. Zuris, D. R. Liu, Programmable editing of a target base in genomic DNA without double-stranded DNA cleavage. *Nature* 533, 420-424 (2016).
13. K. Nishida et al., Targeted nucleotide editing using hybrid prokaryotic and vertebrate adaptive immune systems. *Science* 353, (2016).
14. L. A. Gilbert et al., CRISPR-mediated modular RNA-guided regulation of transcription in eukaryotes. *Cell* 154, 442-451 (2013).
15. R. Bowater, A. J. Doherty, Making ends meet: repairing breaks in bacterial DNA by non-homologous end-joining. *PLOS Genet.* 2, e8 (2006).
16. S. Ayora et al., Double-strand break repair in bacteria: a view from *Bacillus subtilis*. *FEMS Microbiol. Rev.* 35, 1055-1081 (2011).
17. J. C. Carlson, A. H. Badran, D. A. Guggiana-Nilo, D. R. Liu, Negative selection and stringency modulation in phage-assisted continuous evolution. *Nat. Chem. Biol.* 10, 216-222 (2014).
18. V. Pattanayak et al., High-throughput profiling of off-target DNA cleavage reveals RNA-programmed Cas9 nuclease specificity. *Nat. Biotechnol.* 31, 839-843 (2013).
19. G. L. Rosano, E. A. Ceccarelli, Recombinant protein expression in *Escherichia coli*: advances and challenges. *Frontiers in microbiology* 5, 172 (2014).
20. A. Lewendon, I. A. Murray, W. V. Shaw, M. R. Gibbs, A. G. Leslie, Replacement of catalytic histidine-195 of chloramphenicol acetyltransferase: evidence for a general base role for glutamate. *Biochemistry* 33, 1944-1950 (1994).
21. D. D. Boehr, P. R. Thompson, G. D. Wright, Molecular mechanism of aminoglycoside antibiotic kinase APH(3')-IIIa: roles of conserved active site residues. *J. Biol. Chem.* 276, 23929-23936 (2001).
22. Y. B. Kim et al., Increasing the genome-targeting scope and precision of base editing with engineered Cas9-cytidine deaminase fusions. *Nat. Biotechnol.* 35, 371-376 (2017).
23. N. M. Gaudelli et al., Programmable base editing of A*T to G*C in genomic DNA without DNA cleavage. *Nature* 551, 464-471 (2017).
24. A. C. Komor et al., Improved base excision repair inhibition and bacteriophage Mu Gam protein yields C·G-to-T·A base editors with higher efficiency and product purity. *Science advances* 3, eaao4774 (2017).
25. L. Yang et al., Engineering and optimising deaminase fusions for genome editing. *Nat. Commun.* 7, 13330 (2016).
26. H. A. Rees et al., Improving the DNA specificity and applicability of base editing through protein engineering and protein delivery. *Nat. Commun.* 8, 15790 (2017).
27. K. Kim et al., Highly efficient RNA-guided base editing in mouse embryos. *Nat. Biotechnol.* 35, 435-437 (2017).
28. C. Kuscu et al., CRISPR-STOP: gene silencing through base-editing-induced nonsense mutations. *Nat. Methods* 14, 710-712 (2017).
29. Z. Shimatani et al., Targeted base editing in rice and tomato using a CRISPR-Cas9 cytidine deaminase fusion. *Nat. Biotechnol.* 35, 441-443 (2017).
30. Y. Zong et al., Precise base editing in rice, wheat and maize with a Cas9-cytidine deaminase fusion. *Nat. Biotechnol.* 35, 438-440 (2017).
31. W. Xiong, J. E. Ferrell, Jr., A positive-feedback-based bistable 'memory module' that governs a cell fate decision. *Nature* 426, 460-465 (2003).
32. V. Hsiao, Y. Hori, P. W. Rothemund, R. M. Murray, A population-based temporal logic gate for timing and recording chemical events. *Mol. Syst. Biol.* 12, 869 (2016).
33. L. Weiner, J. L. Brissette, P. Model, Stress-induced expression of the *Escherichia coli* phage shock protein operon is dependent on sigma 54 and modulated by positive and negative feedback mechanisms. *Genes Dev.* 5, 1912-1923 (1991).
34. G. Rowley, M. Spector, J. Kormanec, M. Roberts, Pushing the envelope: extracytoplasmic stress responses in bacterial pathogens. *Nat. Rev. Microbiol.* 4, 383-394 (2006).
35. B. P. Hubbard et al., Continuous directed evolution of DNA-binding proteins to improve TALEN specificity. *Nat. Methods* 12, 939-942 (2015).
36. R. Ohlendorf, R. R. Vidavski, A. Eldar, K. Moffat, A. Moglich, From dusk till dawn: one-plasmid systems for light-regulated gene expression. *J. Mol. Biol.* 416, 534-542 (2012).
37. M. Sadelain, E. P. Papapetrou, F. D. Bushman, Safe harbours for the integration of new DNA in the human genome. *Nat. Rev. Cancer* 12, 51-58 (2011).
38. H. Clevers, R. Nusse, Wnt/beta-catenin signaling and disease. *Cell* 149, 1192-1205 (2012).
39. V. Korinek et al., Constitutive transcriptional activation by a beta-catenin-Tcf complex in APC-/- colon carcinoma. *Science* 275, 1784-1787 (1997).
40. C. M. Hedgepeth et al., Activation of the Wnt signaling pathway: a molecular mechanism for lithium action. *Dev. Biol.* 185, 82-91 (1997).
41. K. L. Frieda et al., Synthetic recording and in situ readout of lineage information in single cells. *Nature* 541, 107-111 (2017).
42. S. D. Perli, C. H. Cui, T. K. Lu, Continuous genetic recording with self-targeting CRISPR-Cas in human cells. *Science* 353, (2016). 43. S. Ringquist et al., Translation initiation in *Escherichia coli*: sequences within the ribosome-binding site. *Mol. Microbiol.* 6, 1219-1229 (1992).
44. J. C. Carlson, A. H. Badran, D. A. Guggiana-Nilo, D. R. Liu, Negative selection and stringency modulation in phage-assisted continuous evolution. *Nat. Chem. Biol.* 10, 216-222 (2014).
45. J. A. Zuris et al., Cationic lipid-mediated delivery of proteins enables efficient protein-based genome editing in vitro and in vivo. *Nat. Biotechnol.* 33, 73-80 (2015).
46. S. D. Perli, C. H. Cui, T. K. Lu, Continuous genetic recording with self-targeting CRISPR-Cas in human cells. *Science* 353, (2016).
47. V. Korinek et al., Constitutive transcriptional activation by a beta-catenin-Tcf complex in APC-/- colon carcinoma. *Science* 275, 1784-1787 (1997).

VKVVDELVKVMGRHKPENIVI-
EMARENOTTQKGQKNSRERMKRIEEGIKEL-
GSQILKEHPVENTQLQNEKLYLY YLQN-
GRDMYVDQELDINRLSDYDVDHIVPQSFLKDDSID-
NKVLTRSDKNRGKSDNVP-
SEEVVKKMKNYWRQLLN AKLITQRKFDNLTKAERG
GLSELDKAGFIKROLVETROITKHVAQILDSRM-
NTKYDENDKLIREVKVITLKSKLVSDERKDFQFY-
KVREINNYHHAHDAYLNAVVGTALIKKYPKLESE-
FVYGDYKVYDVRKMIAKSEQEIGKATAKYFFYSNI-
MNFFKTEITLANGEIRKRPLIETNGETGEIVWDKG-
RDFATVRKVLSMPQVNIVKKTEVQTGGFSKESI
LPKRNSDKLIARKKDWDPKKYGGFDSPTVAYSVLV-
VAKVEKGKSKKLKSVKELLGITIMERSSFEKNPID-
FLEA KGYKEVKKDLIIKLPKYSLFELENGRKRMLA-

SAGELQKGNELALPSKYVNFLYLASHYEKLKG-SPEDNEQKOLF VEQHKHYLDEIIEQISEFSKR-VILADANLDKVLSAYNKHRDKPIREQAE-NIIHLFTLTNLGAPAAFKYFDTTID RKRYTSTKEVL-DATLIHQSITGLYETRIDLSQLGGD (SEQ ID NO: 10) (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis*I (NCBI Ref: NC_018721.1); *Streptococcus thermophilus* (NCBI Ref: YP_820832.1), *Geobacillus stearothermophilus* (NCBI Ref: NZ_CP008934.1); *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any of the organisms listed in Example 1.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and/or H840A mutation. In some embodiments, a dCas9 domain comprises the amino acid sequence of SEQ ID NO: 6.

In some embodiments, the Cas9 domain comprises a D10A mutation, while the residue at position 840 remains a histidine in the amino acid sequence provided in SEQ ID NO: 10, or at corresponding positions in any of the amino acid sequences provided in SEQ ID NOs: 11-260. Without wishing to be bound by any particular theory, the presence of the catalytic residue H840 restores the activity of the Cas9 to cleave the non-edited (e.g., non-deaminated) strand containing a G opposite the targeted C. Restoration of H840 (e.g., from A840) does not result in the cleavage of the target strand containing the C. Such Cas9 variants are able to generate a single-strand DNA break (nick) at a specific location based on the gRNA-defined target sequence, leading to repair of the non-edited strand, ultimately resulting in a G to A change on the non-edited strand. Briefly, the C of a C-G base pair can be deaminated to a U by a deaminase, e.g., an APOBEC deaminase. Nicking the non-edited strand, the strand having the G, facilitates removal of the G via mismatch repair mechanisms. Uracil-DNA glycosylase inhibitor protein (UGI) inhibits Uracil-DNA glycosylase (UDG), which prevents removal of the U.

In other embodiments, dCas9 variants having mutations other than D10A and H840A are provided, which, e.g., result in nuclease inactivated Cas9 (dCas9). Such mutations, by way of example, include other amino acid substitutions at D10 and H820, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 10) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 10. In some embodiments, variants of dCas9 (e.g., variants of SEQ ID NO: 10) are provided having amino acid sequences which are shorter, or longer than SEQ ID NO: 10, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

An exemplary alignment of four Cas9 sequences is provided below. The Cas9 sequences in the alignment are: Sequence 1 (S1): SEQ ID NO: 11|WP_010922251| gi 499224711|type II CRISPR RNA-guided endonuclease Cas9 [*Streptococcus pyogenes*]; Sequence 2 (S2): SEQ ID NO: 12|WP_039695303|gi 746743737|type II CRISPR RNA-guided endonuclease Cas9 [*Streptococcus* gallolyticus]; Sequence 3 (S3): SEQ ID NO: 13| WP_045635197|gi 782887988|type II CRISPR RNA-guided endonuclease Cas9 [*Streptococcus mitis*]; Sequence 4 (S4): SEQ ID NO: 14| 5AXW_A| gi 924443546| *Staphylococcus aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 11-14 (e.g., S1, S2, S3, and S4, respectively) are mutated as described herein. The residues D10 and H840 in Cas9 of SEQ ID NO: 10 that correspond to the residues identified in SEQ ID NOs: 11-14 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 10 herein, e.g., mutations of residues 10, and 840 in SEQ ID NO: 10, are referred to herein as "homologous" or "corresponding" mutations. For example, the mutations corresponding to the D10A mutation in SEQ ID NO: 10 or S1 (SEQ ID NO: 11) for the four aligned sequences above are D11A for S2, D10A for S3, and D13A for S4; the corresponding mutations for H840A in SEQ ID NO: 10 or S1 (SEQ ID NO: 11) are H850A for S2, H842A for S3, and H560A for S4.

SEQUENCE LISTING (865 sequences)

SEQ ID NO: 1 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - DNA, 4212 bp, Unknown
  source: /note="Description of Unknown: Cas9 sequence"
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 4 - protein, 1368 aa, Unknown
  source: /note="Description of Unknown: Cas9 sequence"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 6 - protein, 1368 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 7 - protein, 1368 aa, Artificial Sequence; identical to SEQ ID NO: 4
  source: /note="Description of Artificial Sequence: Synthetic polypeptide"

SEQ ID NO: 8 - protein, 1368 aa, Artificial Sequence
  source: /note="Description of Artificial Sequence: Synthetic polypeptide"
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 9 - protein, 1368 aa, Artificial Sequence; identical to SEQ ID NO: 6
  source: /note="Description of Artificial Sequence: Synthetic polypeptide"

SEQ ID NO: 10 - protein, 1368 aa, Streptococcus pyogenes [sequence omitted]

SEQ ID NO: 11 - protein, 1368 aa, Streptococcus pyogenes [sequence omitted]

SEQ ID NO: 12 - protein, 1372 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 13 - protein, 1370 aa, Streptococcus gordonii
MKKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 14 - protein, 1056 aa, Staphylococcus aureus
GSHMKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKAYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 15 - protein, 1052 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 16 - protein, 1368 aa, Streptococcus pyogenes [sequence omitted]

SEQ ID NO: 17 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 19 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 20 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 21 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 22 - protein, 1367 aa, Streptococcus pyogenes; identical to SEQ ID NO: 2

SEQ ID NO: 23 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 24 - protein, 1367 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 25 - protein, 1367 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 26 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 27 - protein, 1368 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 29 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 30 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 31 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 34 - protein, 1193 aa, Streptococcus pyogenes
PDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 37 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENLINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 38 - protein, 1279 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 543 aa, Streptococcus pyogenes
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 306 aa, Streptococcus pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 42 - protein, 1345 aa, Streptococcus sp.
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 43 - protein, 1373 aa, Streptococcus sp.
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 44 - protein, 1370 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 45 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 46 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 47 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 48 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 49 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 50 - protein, 1370 aa, Streptococcus sp.
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 51 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 52 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 53 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 54 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 55 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 56 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 57 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 58 - protein, 1370 aa, Streptococcus sp.
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 59 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 60 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 61 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 62 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 63 - protein, 1370 aa, Streptococcus agalactiae
  MOD_RES (117)..(117): Any amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 64 - protein, 1370 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 65 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 66 - protein, 1370 aa, Streptococcus sp.
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 67 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 68 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 69 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 70 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 71 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 72 - protein, 1370 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 73 - protein, 1370 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 74 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 75 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 76 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 77 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 78 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 79 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 80 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 81 - protein, 1384 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 82 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 83 - protein, 1370 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 84 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 85 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 86 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 87 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 88 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 89 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 90 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 91 - protein, 1370 aa, Streptococcus agalactiae
  MOD_RES (9)..(9): Any amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 92 - protein, 1370 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASDLNGNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 93 - protein, 1386 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 94 - protein, 1346 aa, Streptococcus anginosus
MMKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 95 - protein, 1346 aa, Streptococcus anginosus
MMKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 96 - protein, 1345 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 97 - protein, 1377 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVRKLVAKSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 98 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 99 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 100 - protein, 1365 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTNLDNPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVRKFIAKSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 101 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 102 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 103 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 104 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 105 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 106 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 107 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 108 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 109 - protein, 1348 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 110 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 111 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 112 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 113 - protein, 1372 aa, Streptococcus gallolyticus; identical to SEQ ID NO: 12

SEQ ID NO: 114 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 115 - protein, 1368 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 116 - protein, 1273 aa, Streptococcus iniae
  MOD_RES (1267)..(1267): Any amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFXEVKSSF

SEQ ID NO: 117 - protein, 1267 aa, Streptococcus iniae
  MOD_RES (1265)..(1265): Any amino acid
  MOD_RES (1267)..(1267): Any amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYXFX

SEQ ID NO: 118 - protein, 200 aa, Streptococcus iniae
MEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 119 - protein, 1281 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDVRLSQVFRVTNVEF

SEQ ID NO: 120 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 121 - protein, 1353 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGLYKKDAKRGLVPTSKRVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKISATERMRMYNNILKFISKDKKVDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVALLNFTMMGAATDFKFFGQIIPRKRYPSTTECLKSTLIHQSVTGLYETRIDLSKLGEN

SEQ ID NO: 122 - protein, 1376 aa, Streptococcus oralis
MNNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHGLDSNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLKRYISRTKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 123 - protein, 1370 aa, Streptococcus gordonii; identical to SEQ ID NO: 13

SEQ ID NO: 124 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 125 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 126 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 127 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 128 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 129 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 130 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 131 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 132 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 133 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 134 - protein, 1355 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 135 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 136 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 137 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 138 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 139 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 140 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 141 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 142 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 143 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 144 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 145 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 146 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 147 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 148 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 149 - protein, 1359 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 150 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 151 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 152 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 153 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 154 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 155 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 156 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 157 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 158 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 159 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 160 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 161 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 162 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 163 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 164 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 165 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 166 - protein, 1355 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 167 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 168 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 169 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 170 - protein, 1373 aa, Streptococcus oralis
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 171 - protein, 1371 aa, Streptococcus oralis
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 172 - protein, 1366 aa, Streptococcus parasanguinis
MKKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGSNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLKRYISRTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 173 - protein, 1337 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDKIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIEDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLASLVVKSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASAKELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 174 - protein, 1368 aa, Streptococcus phocae
MVEKKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDQLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKADGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLKRMVGKSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASATELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 175 - protein, 1376 aa, Streptococcus pseudopneumoniae
MSNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASGLNSNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLKRYISRSRDPKEIEKATEKYFFYSNLLNFFKEEVHYADGTIVKRENIEYSKDTGEIAWNKEIDFATIRKILSLSQVNIVKKTEEQTVGQNGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 176 - protein, 1376 aa, Streptococcus pseudopneumoniae
MSNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASGLNSKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLKRYISRSKDPKDIEKATEKYFFYSNLLNFFKEEVHYADGTIVKRENIEYSKDTGEIAWNKEKDFATIKKILSLPQVNIVKKTEEQTVGQNGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 177 - protein, 1378 aa, Streptococcus pseudopneumoniae
MSNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLKRYISRSKDPKDIEKATEKYFFYSNLLNFFKEEVHYADGTIVKRENIEYSKDTGEIAWNKEKDFATIKKVLSYPQVNIVKKTEEQTVGQNGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 178 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 179 - protein, 1326 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 180 - protein, 1370 aa, Streptococcus sanguinis
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 181 - protein, 1377 aa, Streptococcus sanguinis
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 182 - protein, 1371 aa, Streptococcus sp.
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 183 - protein, 1361 aa, Streptococcus varani
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKSATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 184 - protein, 1375 aa, Streptococcus sp.
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 185 - protein, 1371 aa, Streptococcus sp.
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 186 - protein, 1364 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 187 - protein, 1366 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 188 - protein, 1366 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 189 - protein, 1364 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 190 - protein, 1386 aa, Streptococcus sp.
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKNLDNPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 191 - protein, 1300 aa, Brochothrix thermosphacta
MWGVSLFEAGKTAAERRGYRSTRRRLNHRKFRLRLLEDMFEKEILSKDPSFFIRLKEAFLSPKDEQKQFKGNILFNDKDYTDADYYEQYKTIYHLRYDLISQHRQFDIREVYLAIHHLIKYRGHFIYEDQTFTTDGNQLQHHIKAIITMINSTLNRIIIPETIDINVFEKILLDRMMNRSSKVKFLIELTGEDKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGAKSSNYEESKNIKKGLSAAYGKYSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPVSGDEDHKLSINEILWQTNENFMQIIRNKDYLFKKIIEEQFENETALLNKQRIDELAASPANKKGIWQAIKIVKELEKVLQQPAENIFIEFARSDEESKRSTPRDKFIEKAYAQLKKETDTFNLEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKSAAKPKFTFIVENLSKQQYNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGPSERHNARQLIVSDEAAKVIWLISTKQADEAMFLKYYRLEHLEAVFEELIRKQAADYQIFEKLIKKIEVNKVYFYSCTYNEKVKVIEELLKITQANATNGDLKLLKMSNREGRLGSVSVALDFKIINQSVTGLYQSIEDYNN

SEQ ID NO: 192 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 193 - protein, 1389 aa, Artificial Sequence
  source: /note="Description of Artificial Sequence: Synthetic polypeptide"
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGPPKKKRKVYPYDVPDYA

SEQ ID NO: 194 - protein, 1335 aa, Urinacoccus massiliensis
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENLEIIYNDELLTQIENIFKQDISRSKKLDQAIALFQGVKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKKLLEKDEDEILEEIIKILTIFEDRKMRKRQLMKFKDKLSEKAINQLSKKHYTGWGQLSEKLINGIRDEQSNKTILDYLIEDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSVHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKIEGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGASKENDSKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 195 - protein, 1384 aa, Artificial Sequence
  source: /note="Description of Artificial Sequence: Synthetic polypeptide"
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSGGAAG

SEQ ID NO: 196 - protein, 1332 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 197 - protein, 1337 aa, Enterococcus sp.
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 198 - protein, 1288 aa, Enterococcus faecalis
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 199 - protein, 1079 aa, Enterococcus durans
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNTERVAELLEQPEMNAMFEDIVKILTIFEDREMIRTQLKKYQSVLGDGFFKKLVKKHYTGWGRLSERLINGIRDKKTNKTILDYLIDDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASHKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 200 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 201 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 202 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 203 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 204 - protein, 1339 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 205 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 206 - protein, 1337 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 207 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 208 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 209 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 210 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 211 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 212 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 213 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 214 - protein, 1340 aa, Enterococcus sp.
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 215 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 216 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 217 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 218 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 219 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMEQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 220 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 221 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 222 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 223 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 224 - protein, 1330 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSDQMDTLLDDPDMTTMFEEIIKILTIFEDREMIREQLKPYETVLGLPAIKKLAKKHYTGWGRLSEKMIQGMREKQSRKTILDYLIDDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASHQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGERL

SEQ ID NO: 225 - protein, 1334 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEVPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSKVVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIEDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 226 - protein, 1330 aa, Enterococcus massiliensis
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSKKTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLINDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 227 - protein, 1339 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYTEKIIELLEQPEMEEMFEDIVKIITIFEDREMVRTQLKKYQRILGEEIFKKLVKKKYTGWGRLSKRLINGIRDQKTNKTILDYLINDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASHQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 228 - protein, 1424 aa, Artificial Sequence
  source: /note="Description of Artificial Sequence: Synthetic polypeptide"
MDYKDHDGDYKDHDIDYKDDDDKMAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKKK

SEQ ID NO: 229 - protein, 1343 aa, Kandleria vitulina
MSQNNNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNNKNKDKEFNKNKDGFILNSMRNLYADKDTGEVVWDPEWISRIKKCFYYKDCFVTKKLEENNGSFFNLTVRPNDEHSEKGTTIAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSPTEIVNARQLILDFNCTRIIDGIYKAMKYKNYSELSQEEIMNVYDIFVEKLKLYYPTYKNIATNFENMREQFENISDEEKCEVIRQMLVVMHAGPQNGNITFDDFKLSNRLGRLNCKTISLDTTVFIADSPTGMYSKKYKL

SEQ ID NO: 230 - protein, 1344 aa, Kandleria vitulina
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 231 - protein, 1314 aa, Lactobacillus animalis
MLKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDTYSFKETIKNAQVIEKEETLAKTVQELPGSPAIKKGILQSLEIVDEIIKVMGYKPKSIVVEMARETQKTHGTRKREDRVQQIVKNLKDANELPKKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 232 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKLYPQTSLFNDRTDRAFYDDYPTIYHLRYKLMTEKRQFDIREIYLAMHHIVKYRGHFLNEAPVSSFKSSEINLVAHFDRLNTIFADLFSESGFQLETDKLAEVKALLLDNHQSASNRQRQALLLIYTPSTNKAVEKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISNELLNNTEIRNELKDLSNSALSNTRLFLYFMQGGRDMYTGDSLNIDRLSTYDIDHILPQSFIKDNSLDNRVLVSQRMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWNKESGLAYLNKIYQFKKILVTREVHENSGALFNQTLYAAKDDKASGQGGKQLIPAKQDRPTALYGGYSGKTVAYMCIVRIKNKKGDLYKVCGVETSWLAQLKQLTDEDSKKAFLKQKISPQFTKVKKQKGTIVKVVEDFEVIAPHILINQRFFDNGQELTLGSATYKHNEQELILDKTAVKLLNGALPLTQSEELAEQVYDEILDQVMHYFPLYDTNQFRAKLSAGKAAFMKLPWKSQWDGNKMVQVGQQVILDRVLIGLHANAAVSDLGVLKISTPLGKMQQPSGISLSPDTQIIYQSPTGLFERRVALRDL

SEQ ID NO: 233 - protein, 1356 aa, Lactobacillus farciminis
MTKKEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTLDKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNYSVLDLMWTTNNNFISIISNDKYDFKNYIENHNLNKNEDQNISNLVNDIHVSPALKRGITQSIKIVQEIVKFMGHAPKYIFIEVTRETKKSEITTSRGKRIQRLQSKLLNKANGFKPQLRKYLVPNEKIQEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALSDQDDRYHFKHPELVKNRNINDFHHAQDAYLASFLGTYRLRRFPTDEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREIANRQQLILPPEHSALLRILQIPDEDPDQILAFYDKNILVEILQELITKMKKFYPFYKNEQEFLASNIENFNQATTSEKINSLEELITLLHANSTSAHLIFNNIEKKAFGRKTHGLTLNDTDFIYQSVTGLYETRIHIE

SEQ ID NO: 234 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 235 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 236 - protein, 1337 aa, Listeria innocua
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 237 - protein, 1103 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 238 - protein, 1334 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIEEGSLTRLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGKTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 239 - protein, 953 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 240 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 241 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 242 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 243 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 244 - protein, 1334 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 245 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 246 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEEGTLAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 247 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 248 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 249 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 250 - protein, 1337 aa, Listeria monocytogenes
MKNMKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 251 - protein, 1337 aa, Listeria monocytogenes
MKNMKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 252 - protein, 782 aa, Listeria monocytogenes
  MOD_RES (722)..(722): Any amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 253 - protein, 1334 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIEEGSLTRIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGKTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 254 - protein, 1400 aa, Artificial Sequence
  source: /note="Description of Artificial Sequence: Synthetic polypeptide"
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 255 - protein, 1333 aa, Roseburia hominis
MSQNIVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDVFTQFADFNNIPYEDDEKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRPNKAPVDEFYKFVKKCIEKVDTPEAKQILHDIELENFLLKQNSRTNGSVPYQMQLDEMIKIIDNQAKYYPVLKEKREQLLSILTFRIPYYFGPLNETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADNRFGSSVTVLDVLEMSRLNLMEIINDKELGYAQMIEEASSCPKDGKFTYEEVAKLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKKWKDGFVINSMNYPYEVDGKLIWNPDLINEIKKCFYYKDCYCTTKLDQKSGQMFNLTVLPNDAHSAKGTTEAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSPTECVNAMQLVLNEEQCKLIADIYNAIYKQDFDGLDNMLMIQLYLQLIDKLKTLYPIYMGIVEKFEKLTEDFVSISKEEKANVIKQMLIIMHKGPQNGNIIYDDFNVGKRIGRLNGRTFYLDNIEFISQSPTGIYTKKYKL

SEQ ID NO: 256 - protein, 1335 aa, Sharpea azabuensis
MAKNKDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGNDYKDNYNLFIEKDFNDKTYYDKYPTIYHLRKELCENKEKADPRLIYLALHHIVKYRGNFLYEGQSFTMDNSDIEERLNSAIEKFMSINEFDNRIVESDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYPKDTPVEEFYKYIKGLLAKVDTDEAREILERIDLEKFMLKQNSRTNGSIPYQMQKDEMIQIIDNQSVYYPQLKENRDKLISILEFRIPYYFGPLNAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADNEFGSKATVLFVLENSNKNLMEIINDEKLGYKQIIEESNMQDIEGPFKYDEVKKLAGSPAIKRGIWQALLVVREITKFMKHEPSHIYIEFAREEQEKVRKESKIAKLQKIYENLNLQTKEDQQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKDVKHHNNYGFILNSMNHLQSDIDTGEVMWDPAKIGKIKSCFYYKDVYVTKKLEQNSGTLFNVTVLPNDAHSEKGITAATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSPTEYVTARQLSLNEQSCKLISEIYAAMLKKRYEYLDEEEIFDLYLQLLQKMDTLYPAYKGIAKRFFDRAEDFKNIDVVEKCDVIKQILIIMHAGPMNGNIMYDDFKFTNRIGRFTHKNIDLNKTTFISTSVTGLFSKKYKL

SEQ ID NO: 257 - protein, 1417 aa, Artificial Sequence
  source: /note="Description of Artificial Sequence: Synthetic polypeptide"
MDYKDDDDKDYKDDDDKMAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 258 - protein, 1368 aa, Artificial Sequence; identical to SEQ ID NO: 6
  source: /note="Description of Artificial Sequence: Synthetic polypeptide"

SEQ ID NO: 259 - protein, 1376 aa, Artificial Sequence
  source: /note="Description of Artificial Sequence: Synthetic polypeptide"
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPPKKKRKV

SEQ ID NO: 260 - protein, 1372 aa, Artificial Sequence
  source: /note="Description of Artificial Sequence: Synthetic polypeptide"
GAASMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 261 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 262 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 263 - protein, 1367 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 264 - protein, 1367 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 265 - protein, 1367 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 266 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 267 - protein, 1052 aa, Artificial Sequence
  source: /note="Description of Artificial Sequence: Synthetic polypeptide"
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 268 - protein, 1052 aa, Artificial Sequence
  source: /note="Description of Artificial Sequence: Synthetic polypeptide"
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 269-299 - skipped (31 entries)

SEQ ID NO: 300 - protein, 120 aa, Artificial Sequence
  source: /note="Description of Artificial Sequence: Synthetic polypeptide"
  SITE (1)..(120): /note="This sequence may encompass 1-30 'Gly Gly Gly Ser' repeating units"
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 301 - protein, 150 aa, Artificial Sequence
  source: /note="Description of Artificial Sequence: Synthetic polypeptide"
  SITE (1)..(150): /note="This sequence may encompass 1-30 'Gly Gly Gly Gly Ser' repeating units"
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 302 - protein, 30 aa, Artificial Sequence
  source: /note="Description of Artificial Sequence: Synthetic polypeptide"
  SITE (1)..(30): /note="This sequence may encompass 1-30 residues"
GGGGGGGGGGGGGGGGGGGGGGGGGGGGGG

SEQ ID NO: 303 - protein, 150 aa, Artificial Sequence
  source: /note="Description of Artificial Sequence: Synthetic polypeptide"
  SITE (1)..(150): /note="This sequence may encompass 1-30 'Glu Ala Ala Ala Lys' repeating units"
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 304 - protein, 90 aa, Artificial Sequence
  source: /note="Description of Artificial Sequence: Synthetic polypeptide"
  SITE (1)..(90): /note="This sequence may encompass 1-30 'Gly Gly Ser' repeating units"
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 305 - protein, 120 aa, Artificial Sequence
  source: /note="Description of Artificial Sequence: Synthetic polypeptide"
  SITE (1)..(120): /note="This sequence may encompass 1-30 'Ser Gly Gly Ser' repeating units"
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 306 - protein, 16 aa, Artificial Sequence
  source: /note="Description of Artificial Sequence: Synthetic peptide"
SGSETPGTSESATPES

SEQ ID NO: 307 - protein, 94 aa, Artificial Sequence
  source: /note="Description of Artificial Sequence: Synthetic polypeptide"
  SITE (5)..(94): /note="This region may encompass 1-30 'Gly Gly Ser' repeating units"
SGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 308 - protein, 32 aa, Artificial Sequence
  source: /note="Description of Artificial Sequence: Synthetic polypeptide"
SGGSSGGSSGSETPGTSESATPESSGGSSGGS

SEQ ID NO: 309 - protein, 4 aa, Artificial Sequence
  source: /note="Description of Artificial Sequence: Synthetic peptide"
SGGS

SEQ ID NO: 310 - protein, 256 aa, Artificial Sequence
  source: /note="Description of Artificial Sequence: Synthetic polypeptide"
  SITE (1)..(120): /note="This region may encompass 1-30 'Ser Gly Gly Ser' repeating units"
  SITE (137)..(256): /note="This region may encompass 1-30 'Ser Gly Gly Ser' repeating units"
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGSETPGTSESATPESSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 311 - protein, 9 aa, Artificial Sequence
  source: /note="Description of Artificial Sequence: Synthetic peptide"
GGSGGSGGS

SEQ ID NO: 312 - protein, 21 aa, Artificial Sequence
  source: /note="Description of Artificial Sequence: Synthetic peptide"
GGSGGSGGSGGSGGSGGSGGS

SEQ ID NO: 313 - protein, 5 aa, Artificial Sequence
  source: /note="Description of Artificial Sequence: Synthetic peptide"
GGGGS

SEQ ID NO: 314 - protein, 104 aa, Artificial Sequence
  source: /note="Description of Artificial Sequence: Synthetic polypeptide"
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 315 - protein, 24 aa, Artificial Sequence
  source: /note="Description of Artificial Sequence: Synthetic peptide"
SGGSSGGSSGSETPGTSESATPES

SEQ ID NO: 316 - protein, 40 aa, Artificial Sequence
  source: /note="Description of Artificial Sequence: Synthetic polypeptide"
SGGSSGGSSGSETPGTSESATPESSGGSSGGSSGGSSGGS

SEQ ID NO: 317 - protein, 64 aa, Artificial Sequence
  source: /note="Description of Artificial Sequence: Synthetic polypeptide"
SGGSSGGSSGSETPGTSESATPESSGGSSGGSSGGSSGGSSGSETPGTSESATPESSGGSSGGS

SEQ ID NO: 318 - protein, 92 aa, Artificial Sequence
  source: /note="Description of Artificial Sequence: Synthetic polypeptide"
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 319-349 - skipped (31 entries)

SEQ ID NO: 350 - protein, 198 aa, Homo sapiens [sequence omitted]

SEQ ID NO: 351 - protein, 198 aa, Mus sp.
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 352 - protein, 198 aa, Canis sp.
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 353 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 354 - protein, 429 aa, Mus sp.
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 355 - protein, 429 aa, Rattus sp.
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 356 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 357 - protein, 384 aa, Pan sp.
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 358 - protein, 377 aa, Chlorocebus sp.
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 359 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 360 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 361 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 362 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 363 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 364 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 365 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 366 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 367 - protein, 229 aa, Mus sp.
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 368 - protein, 229 aa, Rattus sp. [sequence omitted]

SEQ ID NO: 369-373 - skipped (5 entries)

SEQ ID NO: 374 - protein, 239 aa, Rattus sp.
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 375 - protein, 190 aa, Gorilla sp.
MNPQIRNPMKAMYPGTFYFQFKNLWEANDRNETWLCFTVEGIKRRSVVSWKTGVFRNQVDSETHCHAERCFLSWFCDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 376 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 377 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 378 - protein, 396 aa, Rattus sp.
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFYWRKKFQKGLCTLWRSGIHVDVMDLPQFADCWTNFVNPQRPFRPWNELEKNSWRIQRRLRRIKESWGL

SEQ ID NO: 379 - protein, 227 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAEIRFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 380 - protein, 490 aa, Chlorocebus sp.
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 381 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 382 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 383 - protein, 224 aa, Mus sp.
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 384 - protein, 224 aa, Rattus sp.
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 385 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 386 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 387 - protein, 384 aa, Artificial Sequence
  source: /note="Description of Artificial Sequence: Synthetic polypeptide"
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 388 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 389 - protein, 184 aa, Artificial Sequence
  source: /note="Description of Artificial Sequence: Synthetic polypeptide"
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 390-399 - skipped (10 entries)

SEQ ID NO: 400 - protein, 167 aa, Escherichia coli
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 401 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 402 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 403 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 404 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 405 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 406 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 407 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 408 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 409 - protein, 166 aa, Escherichia coli
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 410 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTD

SEQ ID NO: 411 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTD

SEQ ID NO: 412 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTD

SEQ ID NO: 413 - protein, 166 aa, Artificial Sequence
  source: /note="Description of Artificial Sequence: Synthetic polypeptide"
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTD

SEQ ID NO: 414 - protein, 166 aa, Artificial Sequence
  source: /note="Description of Artificial Sequence: Synthetic polypeptide"
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQDIKAQKKAQSSTD

SEQ ID NO: 415 - protein, 166 aa, Artificial Sequence
  source: /note="Description of Artificial Sequence: Synthetic polypeptide"
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQGIKAQKKAQSSTD

SEQ ID NO: 416 - protein, 166 aa, Artificial Sequence
  source: /note="Description of Artificial Sequence: Synthetic polypeptide"
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQVIKAQKKAQSSTD

SEQ ID NO: 417 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 418 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 419 - protein, 166 aa, Artificial Sequence
  source: /note="Description of Artificial Sequence: Synthetic polypeptide"
AEVEFSHEYWMRHALTLAKRAWDEREVPVGAVLVHNNRVIGEGWNRPFGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 420 - protein, 166 aa, Artificial Sequence
  source: /note="Description of Artificial Sequence: Synthetic polypeptide"
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGTRNAKTGAAGSLMDVLHHPGMSHRVEITEGILADECAALLSDFFRMRRQEIKAQSKAQSSTD

SEQ ID NO: 421 - protein, 166 aa, Artificial Sequence
  source: /note="Description of Artificial Sequence: Synthetic polypeptide"
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 422 - protein, 166 aa, Artificial Sequence
  source: /note="Description of Artificial Sequence: Synthetic polypeptide"
SEVEFSHEYWMRHALTLAKRAWDGGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 423 - protein, 166 aa, Artificial Sequence
  source: /note="Description of Artificial Sequence: Synthetic polypeptide"
SEVEFSHEYWMRHALTLAKRAWDDGEVPVGAVLVHNNRVIGEGWNRPIGRHDPTAHAEIMALRQGGLVMQNYRLIDATLYVTFEPCVMCAGAMIHSRIGRVVFGVKNAKTGAAGSLMDVLHYPGMNHRVEITEGILADECNGLLSYFFRMRRQVFKAQKKAQSSTD

SEQ ID NO: 424 - protein, 166 aa, Artificial Sequence
  source: /note="Description of Artificial Sequence: Synthetic polypeptide"
SEVEFSHEYWMRHALTLAKRAWDEQEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 425 - protein, 166 aa, Artificial Sequence
  source: /note="Description of Artificial Sequence: Synthetic polypeptide"
SEVEFSHEYWMRHALTLAKRAWDMGEVPVGAVLVHNNRVIGEGWNRPIGRHDPTAHAEIMALRQGGLVMQNYRLIDATLYVTFEPCVMCAGAMIHSRIGRVVFGVPNAKTGAAGSLMDVLHYPGMNHRVEITEGILADECNDLLSYFFRMRRQVFKAQKKAQSSTD

SEQ ID NO: 426 - protein, 166 aa, Artificial Sequence
  source: /note="Description of Artificial Sequence: Synthetic polypeptide"
SEVEFSHEYWMRHALTLAKRAWDECEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNALLSYFFRMRRQVFKAQKKAQSSTD

SEQ ID NO: 427 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNLLLSYFFRMRRQVFKAQKKAQSSTD

SEQ ID NO: 428 - protein, 166 aa, Artificial Sequence
  source: /note="Description of Artificial Sequence: Synthetic polypeptide"
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 429 - protein, 166 aa, Artificial Sequence
  source: /note="Description of Artificial Sequence: Synthetic polypeptide"
SEVEFSHEYWMRHALTLAKRAWDAGEVPVGAVLVHNNRVIGEGWNRPIGRHDPTAHAEIMALRQGGLVMQNYRLIDATLYVTFEPCVMCAGAMIHSRIGRVVFGVNNAKTGAAGSLMDVLHYPGMNHRVEITEGILADECNELLSYFFRMRRQVFKAQKKAQSSTD

SEQ ID NO: 430 - protein, 166 aa, Artificial Sequence; identical to SEQ ID NO: 418
  source: /note="Description of Artificial Sequence: Synthetic polypeptide"

SEQ ID NO: 431 - protein, 166 aa, Artificial Sequence
  source: /note="Description of Artificial Sequence: Synthetic polypeptide"
SEVEFSHEYWMRHALTLAKRAWDEREVPVGAVLVHTNRVIGEGWNRTIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 432 - protein, 166 aa, Artificial Sequence
  source: /note="Description of Artificial Sequence: Synthetic polypeptide"
SEVEFSHEYWMRHALTLAKRAWDEREVPVGAVLVHSNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 433 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 434 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLRYFFRMRRQVFKAQKKAQSSTD

SEQ ID NO: 435 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRLIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 436 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 437 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFKAQKKAQSSTD

SEQ ID NO: 438 - protein, 166 aa, Artificial Sequence; identical to SEQ ID NO: 434
  source: /note="Description of Artificial Sequence: Synthetic polypeptide"

SEQ ID NO: 439 - protein, 166 aa, Artificial Sequence
  source: /note="Description of Artificial Sequence: Synthetic polypeptide"
SEVEFSHEYWMRHALTLAKRAWDEREVPVGAVLVHSNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 440 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 441 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGHHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFNAQKKAQSSTD

SEQ ID NO: 442 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRSIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 443 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRTIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 444 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRAIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 445 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECNALLSDFFRMRRQEIKAQKKAQSSTD

SEQ ID NO: 446 - protein, 166 aa, Artificial Sequence
  source: /note="Description of Artificial Sequence: Synthetic polypeptide"
SEVEFSHEYWMRHALTLAKRARDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 447 - protein, 166 aa, Artificial Sequence
  source: /note="Description of Artificial Sequence: Synthetic polypeptide"
SEVEFSHEYWMRHALTLAKRALDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 448 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMPRQEIKAQKKAQSSTD

SEQ ID NO: 449 - protein, 166 aa, Artificial Sequence
  source: /note="Description of Artificial Sequence: Synthetic polypeptide"
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMHRQEIKAQKKAQSSTD

SEQ ID NO: 450 - protein, 166 aa, Artificial Sequence; identical to SEQ ID NO: 418
  source: /note="Description of Artificial Sequence: Synthetic polypeptide"

SEQ ID NO: 451 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 452 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 453 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 454 - protein, 166 aa, Artificial Sequence
  source: /note="Description of Artificial Sequence: Synthetic polypeptide"
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 455 - protein, 166 aa, Artificial Sequence
  source: /note="Description of Artificial Sequence: Synthetic polypeptide"
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 456 - protein, 166 aa, Artificial Sequence
  source: /note="Description of Artificial Sequence: Synthetic polypeptide"
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 457 - protein, 166 aa, Artificial Sequence
  source: /note="Description of Artificial Sequence: Synthetic polypeptide"
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTD

SEQ ID NO: 458 - protein, 166 aa, Artificial Sequence; identical to SEQ ID NO: 454
  source: /note="Description of Artificial Sequence: Synthetic polypeptide"

SEQ ID NO: 459-499 - skipped (41 entries)

SEQ ID NO: 500 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 501 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 502 - protein, 209 aa, Unknown
  source: /note="Description of Unknown: UdgX sequence"
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 503 - protein, 313 aa, Unknown
  source: /note="Description of Unknown: UDG sequence"
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 504-509 - skipped (6 entries)

SEQ ID NO: 510 - protein, 219 aa, Artificial Sequence
  source: /note="Description of Artificial Sequence: Synthetic polypeptide"
KGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 511 - protein, 222 aa, Artificial Sequence
  source: /note="Description of Artificial Sequence: Synthetic polypeptide"
DLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQP

SEQ ID NO: 512-519 - skipped (8 entries)

SEQ ID NO: 520 - protein, 7 aa, Artificial Sequence
  source: /note="Description of Artificial Sequence: Synthetic peptide"
PKKKRKV

SEQ ID NO: 521 - protein, 30 aa, Artificial Sequence
  source: /note="Description of Artificial Sequence: Synthetic polypeptide"
MDSLLMNRRKFLYQFKNVRWAKGRRETYLC

SEQ ID NO: 522 - protein, 11 aa, Artificial Sequence
  source: /note="Description of Artificial Sequence: Synthetic peptide"
SPKKKRKVEAS

SEQ ID NO: 523-539 - skipped (17 entries)

SEQ ID NO: 540 - protein, 1633 aa, Artificial Sequence
  source: /note="Description of Artificial Sequence: Synthetic polypeptide"
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 541 - protein, 1623 aa, Artificial Sequence
  source: /note="Description of Artificial Sequence: Synthetic polypeptide"
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 542 - protein, 1629 aa, Artificial Sequence
  source: /note="Description of Artificial Sequence: Synthetic polypeptide"
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 543 - protein, 1699 aa, Artificial Sequence
  source: /note="Description of Artificial Sequence: Synthetic polypeptide"
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKML

SEQ ID NO: 544 - protein, 1710 aa, Artificial Sequence
  source: /note="Description of Artificial Sequence: Synthetic polypeptide"
MSSETGPVAVDPTLRRRIEPHEFEVFFDPRELRKETCLLYEINWGGRHSIWRHTSQNTNKHVEVNFLEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 545 - protein, 1679 aa, Artificial Sequence
  source: /note="Description of Artificial Sequence: Synthetic polypeptide"
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 546 - protein, 1689 aa, Artificial Sequence
  source: /note="Description of Artificial Sequence: Synthetic polypeptide"
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 547 - protein, 1655 aa, Artificial Sequence
  source: /note="Description of Artificial Sequence: Synthetic polypeptide"
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 548 - protein, 1665 aa, Artificial Sequence
  source: /note="Description of Artificial Sequence: Synthetic polypeptide"
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 549 - protein, 1665 aa, Artificial Sequence
  source: /note="Description of Artificial Sequence: Synthetic polypeptide"
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 550 - protein, 1710 aa, Artificial Sequence
  source: /note="Description of Artificial Sequence: Synthetic polypeptide"
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 551-559 - skipped (9 entries)

SEQ ID NO: 560 - protein, 1561 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 561 - protein, 1561 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 562 - protein, 1561 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 563 - protein, 1561 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 564 - protein, 1550 aa, Artificial Sequence
  source: /note="Description of Artificial Sequence: Synthetic polypeptide"
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 565 - protein, 1550 aa, Artificial Sequence
  source: /note="Description of Artificial Sequence: Synthetic polypeptide"
  VARIANT (155)..(155): /replace="Gly" or "Val"
  SITE (1)..(1550): /note="Variant residues given in the sequence have no preference with respect to those in the annotations for variant positions"
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQDIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 566 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 567 - protein, 1767 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 568 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 569 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 570 - protein, 1767 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRPIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 571 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 572 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 573 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 574 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 575 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 576 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 577 - protein, 1775 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 578 - protein, 1775 aa, Artificial Sequence; identical to SEQ ID NO: 575
  source: /note="Description of Artificial Sequence: Synthetic polypeptide"

SEQ ID NO: 579 - protein, 1767 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 580 - protein, 1767 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRAWDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 581 - protein, 1767 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 582 - protein, 1775 aa, Artificial Sequence; identical to SEQ ID NO: 571
  source: /note="Description of Artificial Sequence: Synthetic polypeptide"

SEQ ID NO: 583 - protein, 1775 aa, Artificial Sequence; identical to SEQ ID NO: 572
  source: /note="Description of Artificial Sequence: Synthetic polypeptide"

SEQ ID NO: 584 - protein, 1775 aa, Artificial Sequence; identical to SEQ ID NO: 576
  source: /note="Description of Artificial Sequence: Synthetic polypeptide"

SEQ ID NO: 585 - protein, 1773 aa, Artificial Sequence
  source: /note="Description of Artificial Sequence: Synthetic polypeptide"
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRALDEREVPVGAVLVLNNRGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 586 - protein, 1775 aa, Artificial Sequence; identical to SEQ ID NO: 575
  source: /note="Description of Artificial Sequence: Synthetic polypeptide"

SEQ ID NO: 587-619 - skipped (33 entries)

SEQ ID NO: 620 - DNA, 23 bp, Artificial Sequence
  source: /note="Description of Artificial Sequence: Synthetic oligonucleotide"
ccaccggcaagctgcccgtgccc

SEQ ID NO: 621 - DNA, 24 bp, Artificial Sequence
  source: /note="Description of Artificial Sequence: Synthetic oligonucleotide"
cctgaggccaagctgcccgtgccc

SEQ ID NO: 622 - DNA, 23 bp, Artificial Sequence
  source: /note="Description of Artificial Sequence: Synthetic oligonucleotide"
ccaccggcaagctgcccatgccc

SEQ ID NO: 623 - DNA, 19 bp, Artificial Sequence
  source: /note="Description of Artificial Sequence: Synthetic oligonucleotide"
accagggctcccacccggt

SEQ ID NO: 624 - DNA, 33 bp, Artificial Sequence
  source: /note="Description of Artificial Sequence: Synthetic oligonucleotide"
catccagtcccaccagggctcccacccggtccc

SEQ ID NO: 625 - DNA, 20 bp, Artificial Sequence
  source: /note="Description of Artificial Sequence: Synthetic oligonucleotide"
catccagtcccaccaaaact

SEQ ID NO: 626 - DNA, 23 bp, Artificial Sequence
  source: /note="Description of Artificial Sequence: Synthetic oligonucleotide"
catccagtcccaccaaaactccc

SEQ ID NO: 627-659 - skipped (33 entries)

SEQ ID NO: 660 - protein, 239 aa, Unknown
  source: /note="Description of Unknown: EGFP sequence"
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 661 - protein, 238 aa, Artificial Sequence
  source: /note="Description of Artificial Sequence: Synthetic polypeptide"
MVSKGEELFTGVVPILVELDGDVNGHKFSVSGEGEGDATYGKLTLKFICTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 662 - protein, 246 aa, Artificial Sequence
  source: /note="Description of Artificial Sequence: Synthetic polypeptide"
MVSKGEELFTGVVPILVELDGDVNGHKFSVSGEGEGDALKTTLTYTYGKLTLKFICTTGKLPVPWPTLGTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 663-666 - skipped (4 entries)

SEQ ID NO: 667 - DNA, 1488 bp, Artificial Sequence
  source: /note="Description of Artificial Sequence: Synthetic polynucleotide"
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatgctgccgtttgtgatggcttccatgtcggcagaatgcttaatgaattacaacagtactgcgatgagtggcagggcggggcgggcagcggttctggctccagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 668 - protein, 495 aa, Artificial Sequence
  source: /note="Description of Artificial Sequence: Synthetic polypeptide"
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHAAVCDGFHVGRMLNELQQYCDEWQGGAGSGSGSSHIQRETSCSRPRLNSNMDADLYGYKWARDNVGQSGATIYRLYGKPDAPELFLKHGKGSVANDVTDEMVRLNWLTEFMPLPTIKHFIRTPDDAWLLTTAIPGKTAFQVLEEYPDSGENIVDALAVFLRRLHSIPVCNCPFNSDRVFRLAQAQSRMNNGLVDASDFDDERNGWPVEQVWKEMHKLLPFSPDSVVTHGDFSLDNLIFDEGKLIGCIDVGRVGIADRYQDLAILWNCLGEFSPSLQKRLFQKYGIDNPDMNKLQFHLMLDEFF

SEQ ID NO: 669 - DNA, 1488 bp, Artificial Sequence
  source: /note="Description of Artificial Sequence: Synthetic polynucleotide"
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcactatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgggcagcggttctggctccagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgctgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 670 - protein, 495 aa, Artificial Sequence
  source: /note="Description of Artificial Sequence: Synthetic polypeptide"
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGAGSGSGSSHIQRETSCSRPRLNSNMDADLYGYKWARDNVGQSGATIYRLYGKPDAPELFLKHGKGSVANDVTDEMVRLNWLTEFMPLPTIKHFIRTPDDAWLLTTAIPGKTAFQVLEEYPDSGENIVDALAVFLRRLHSIPVCNCPFNSDRVFRLAQAQSRMNNGLVDASDFDDERNGWPVEQVWKEMHKLLPFSPDSVVTHGDFSLDNLIFDEGKLIGCIAVGRVGIADRYQDLAILWNCLGEFSPSLQKRLFQKYGIDNPDMNKLQFHLMLDEFF

SEQ ID NO: 671-700 - skipped (30 entries)

SEQ ID NO: 701 - DNA, 20 bp, Artificial Sequence
  source: /note="Description of Artificial Sequence: Synthetic oligonucleotide"
gggcacgggcagcttgccgg

SEQ ID NO: 702 - DNA, 20 bp, Artificial Sequence
  source: /note="Description of Artificial Sequence: Synthetic oligonucleotide"
gggcacgggcagcttgcctc

SEQ ID NO: 703 - DNA, 20 bp, Artificial Sequence
  source: /note="Description of Artificial Sequence: Synthetic oligonucleotide"
gtggtcacgagggtgggcca

SEQ ID NO: 704 - DNA, 20 bp, Artificial Sequence
  source: /note="Description of Artificial Sequence: Synthetic oligonucleotide"
gtaggtcagggtggtcacga

SEQ ID NO: 705 - DNA, 20 bp, Artificial Sequence
  source: /note="Description of Artificial Sequence: Synthetic oligonucleotide"
gtggtcccgagggtgggcca

SEQ ID NO: 706 - DNA, 20 bp, Artificial Sequence
  source: /note="Description of Artificial Sequence: Synthetic oligonucleotide"
gtaggtcagggtggtaaaga

SEQ ID NO: 707 - DNA, 20 bp, Artificial Sequence
  source: /note="Description of Artificial Sequence: Synthetic oligonucleotide"
ggtacctatcgattgtcagg

SEQ ID NO: 708 - DNA, 20 bp, Artificial Sequence
  source: /note="Description of Artificial Sequence: Synthetic oligonucleotide"
caggacggtcacctttgggg

SEQ ID NO: 709 - DNA, 20 bp, Artificial Sequence
  source: /note="Description of Artificial Sequence: Synthetic oligonucleotide"
ggtgacaagtgtgatcactt

SEQ ID NO: 710 - DNA, 50 bp, Artificial Sequence
  source: /note="Description of Artificial Sequence: Synthetic primer"
acactctttccctacacgacgctcttccgatctcggccacaagttcagcg

SEQ ID NO: 711 - DNA, 54 bp, Artificial Sequence
  source: /note="Description of Artificial Sequence: Synthetic primer"
  modified_base (34)..(37): a, c, t, g, unknown or other
acactctttccctacacgacgctcttccgatctnnnncggccacaagttcagcg

SEQ ID NO: 712 - DNA, 55 bp, Artificial Sequence
  source: /note="Description of Artificial Sequence: Synthetic primer"
  modified_base (34)..(37): a, c, t, g, unknown or other
acactctttccctacacgacgctcttccgatctnnnnacggccacaagttcagcg

SEQ ID NO: 713 - DNA, 53 bp, Artificial Sequence
  source: /note="Description of Artificial Sequence: Synthetic primer"
  modified_base (34)..(37): a, c, t, g, unknown or other
acactctttccctacacgacgctcttccgatctnnnnacggcgacgtaaacgg

SEQ ID NO: 714 - DNA, 44 bp, Artificial Sequence
  source: /note="Description of Artificial Sequence: Synthetic primer"
tggagttcagacgtgtgctcttccgatctcttcgggcatggcgg

SEQ ID NO: 715 - DNA, 46 bp, Artificial Sequence
  source: /note="Description of Artificial Sequence: Synthetic primer"
tggagttcagacgtgtgctcttccgatctgctgcttcatgtggtcg

SEQ ID NO: 716 - DNA, 16 bp, Artificial Sequence
  source: /note="Description of Artificial Sequence: Synthetic primer"
acggcgacgtaaacgg

SEQ ID NO: 717 - DNA, 17 bp, Artificial Sequence
  source: /note="Description of Artificial Sequence: Synthetic primer"
gctgcttcatgtggtcg

SEQ ID NO: 718 - DNA, 53 bp, Artificial Sequence
  source: /note="Description of Artificial Sequence: Synthetic primer"
  modified_base (34)..(37): a, c, t, g, unknown or other
acactctttccctacacgacgctcttccgatctnnnnctgtccccttctgggc

SEQ ID NO: 719 - DNA, 55 bp, Artificial Sequence
  source: /note="Description of Artificial Sequence: Synthetic primer"
  modified_base (34)..(37): a, c, t, g, unknown or other
acactctttccctacacgacgctcttccgatctnnnntactgtccccttctgggc

SEQ ID NO: 720 - DNA, 57 bp, Artificial Sequence
  source: /note="Description of Artificial Sequence: Synthetic primer"
  modified_base (34)..(37): a, c, t, g, unknown or other
acactctttccctacacgacgctcttccgatctnnnngtcgtccatgctgtgtttgc

SEQ ID NO: 721 - DNA, 48 bp, Artificial Sequence
  source: /note="Description of Artificial Sequence: Synthetic primer"
tggagttcagacgtgtgctcttccgatctggaaaatgagagctgcagg

SEQ ID NO: 722-799 - skipped (78 entries)

SEQ ID NO: 800 - protein, 36 aa, Artificial Sequence
  source: /note="Description of Artificial Sequence: Synthetic polypeptide"
  MOD_RES (2)..(2): Any amino acid
  MOD_RES (4)..(29): Any amino acid
  SITE (4)..(29): /note="This region may encompass 23-26 residues"
  MOD_RES (32)..(35): Any amino acid
  SITE (32)..(35): /note="This region may encompass 2-4 residues"
HXEXXXXXXXXXXXXXXXXXXXXXXXXXXPCXXXXC

SEQ ID NO: 801 - protein, 96 aa, Artificial Sequence
  source: /note="Description of Artificial Sequence: Synthetic polypeptide"
  SITE (1)..(40): /note="This region may encompass 0-10 'Ser Gly Gly Ser' repeating units"
  SITE (57)..(96): /note="This region may encompass 0-10 'Ser Gly Gly Ser' repeating units"
SGGSSGGSSGGSSGGSSGGSSGGSSGGSSGGSSGGSSGGSSGSETPGTSESATPESSGGSSGGSSGGSSGGSSGGSSGGSSGGSSGGSSGGSSGGS

SEQ ID NO: 802 - protein, 32 aa, Artificial Sequence; identical to SEQ ID NO: 308
  source: /note="Description of Artificial Sequence: Synthetic polypeptide"

SEQ ID NO: 803 - protein, 6 aa, Artificial Sequence
  source: /note="Description of Artificial Sequence: Synthetic 6xHis tag"
HHHHHH

SEQ ID NO: 804 - protein, 8 aa, Artificial Sequence
  source: /note="Description of Artificial Sequence: Synthetic peptide"
SGGSSGGS

SEQ ID NO: 805 - protein, 60 aa, Artificial Sequence
  source: /note="Description of Artificial Sequence: Synthetic polypeptide"
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  SITE (1)..(60): /note="This sequence may encompass 1-30 'Xaa Pro' repeating units"
XPXPXPXPXPXPXPXPXPXPXPXPXPXPXPXPXPXPXPXPXPXPXPXPXPXPXPXPXPXP

SEQ ID NO: 806 - protein, 45 aa, Artificial Sequence
  source: /note="Description of Artificial Sequence: Synthetic polypeptide"
  SITE (1)..(45): /note="This sequence may encompass 1-15 'Gly Gly Ser' repeating units"
GGSGGSGGSGGSGGSGGSGGSGGSGGSGGSGGSGGSGGSGGSGGS

SEQ ID NO: 807 - protein, 21 aa, Artificial Sequence
  source: /note="Description of Artificial Sequence: Synthetic peptide"
  SITE (1)..(21): /note="This sequence may encompass 1, 3 or 7 'Gly Gly Ser' repeating units"
GGSGGSGGSGGSGGSGGSGGS

SEQ ID NO: 808 - DNA, 32 bp, Artificial Sequence
  source: /note="Description of Artificial Sequence: Synthetic oligonucleotide"
tagagggtatataatggaagctcgacttccag

SEQ ID NO: 809 - DNA, 30 bp, Artificial Sequence
  source: /note="Description of Artificial Sequence: Synthetic oligonucleotide"
tttacactttatgcttccggctcgtatgtt

SEQ ID NO: 810 - DNA, 17 bp, Artificial Sequence
  source: /note="Description of Artificial Sequence: Synthetic oligonucleotide"
ttgtgagcggataacaa

SEQ ID NO: 811 - DNA, 31 bp, Artificial Sequence
  source: /note="Description of Artificial Sequence: Synthetic oligonucleotide"
tttacactttatgcttccggctcgtataatg

SEQ ID NO: 812 - DNA, 29 bp, Artificial Sequence
  source: /note="Description of Artificial Sequence: Synthetic oligonucleotide"
ttgacaattaatcatcgaactagttaact

SEQ ID NO: 813 - DNA, 29 bp, Artificial Sequence
  source: /note="Description of Artificial Sequence: Synthetic oligonucleotide"
ttgacaattaatcatcggctcgtataatg

SEQ ID NO: 814 - DNA, 30 bp, Artificial Sequence
  source: /note="Description of Artificial Sequence: Synthetic oligonucleotide"
ttgacaattaatcatccggctcgtataatg

SEQ ID NO: 815 - DNA, 19 bp, Artificial Sequence
  source: /note="Description of Artificial Sequence: Synthetic oligonucleotide"
tccctatcagtgatagaga

SEQ ID NO: 816 - DNA, 30 bp, Artificial Sequence
  source: /note="Description of Artificial Sequence: Synthetic oligonucleotide"
ttgacactctatcattgatagagttatttt

SEQ ID NO: 817 - DNA, 19 bp, Artificial Sequence
  source: /note="Description of Artificial Sequence: Synthetic oligonucleotide"
taatacgactcactatagg

SEQ ID NO: 818 - DNA, 19 bp, Artificial Sequence
  source: /note="Description of Artificial Sequence: Synthetic oligonucleotide"
aattaaccctcactaaagg

SEQ ID NO: 819 - DNA, 45 bp, Artificial Sequence
  source: /note="Description of Artificial Sequence: Synthetic oligonucleotide"
tcataaaaaatttatttgctttgtgagcggataacaattataata

SEQ ID NO: 820 - DNA, 166 bp, Artificial Sequence
  source: /note="Description of Artificial Sequence: Synthetic polynucleotide"
aaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccat

SEQ ID NO: 821 - DNA, 29 bp, Artificial Sequence
  source: /note="Description of Artificial Sequence: Synthetic oligonucleotide"
attgcgagctctattccgtgataatttgg

SEQ ID NO: 822 - DNA, 119 bp, Artificial Sequence
  source: /note="Description of Artificial Sequence: Synthetic polynucleotide"
caccacaattcagcaaattgtgaacatcatcacgttcatctttccctggttgccaatggcccattttcctgtcagtaacgagaaggtcgcgaattcaggcgctttttagactggtcgta

SEQ ID NO: 823 - DNA, 59 bp, Artificial Sequence
  source: /note="Description of Artificial Sequence: Synthetic oligonucleotide"
tatctctggcggtgttgacataaataccactggcggtgatactgagcacatcagcagga

SEQ ID NO: 824 - DNA, 59 bp, Artificial Sequence
  source: /note="Description of Artificial Sequence: Synthetic oligonucleotide"
taacaccgtgcgtgttgactgttttacctctggcggtgataatggttgcatgtactaag

SEQ ID NO: 825 - DNA, 274 bp, Artificial Sequence
  source: /note="Description of Artificial Sequence: Synthetic polynucleotide"
gcagattgagtaaccgtgaatgtttgtacaaatgtttcaaagatgttactatgagtgtcccggccagcatcactttatattttgtgacgtctggccggacgttttccctagtgttggctgttttagcgacctggccgtacaggtcaggtttttttttaccgctaaacaactgaagccattgtaacctctgaatgattcattgtaagttactcttaagtatcatcttgcctgtactatagtgcaggttaagtccacgttaagtaaaagaagcagc

SEQ ID NO: 826 - DNA, 45 bp, Artificial Sequence
  source: /note="Description of Artificial Sequence: Synthetic oligonucleotide"
gctttgtttttattttttaatgtatttgtacatggagaaaataaa

SEQ ID NO: 827 - DNA, 70 bp, Artificial Sequence
  source: /note="Description of Artificial Sequence: Synthetic oligonucleotide"
acttgatactgtatgagcatacagtataattgcttcaacagaacatattgactatccggtattacccggc

SEQ ID NO: 828 - DNA, 19 bp, Artificial Sequence
  source: /note="Description of Artificial Sequence: Synthetic oligonucleotide"
atttaggtgacactataga

SEQ ID NO: 829 - DNA, 204 bp, Artificial Sequence
  source: /note="Description of Artificial Sequence: Synthetic polynucleotide"
gtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 830 - DNA, 317 bp, Artificial Sequence
  source: /note="Description of Artificial Sequence: Synthetic polynucleotide"
ggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaa

SEQ ID NO: 831 - DNA, 1179 bp, Artificial Sequence
  source: /note="Description of Artificial Sequence: Synthetic polynucleotide"
ggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 832 - DNA, 103 bp, Artificial Sequence
  source: /note="Description of Artificial Sequence: Synthetic polynucleotide"
gggcacgggcagcttgccgggttttagagctagaaatagcaagttaaaataaggctagtccgttatcaacttgaaaaagtggcaccgagtcggtgcttttttt

SEQ ID NO: 833 - DNA, 103 bp, Artificial Sequence
  source: /note="Description of Artificial Sequence: Synthetic polynucleotide"
gggcacgggcagcttgcctcgttttagagctagaaatagcaagttaaaataaggctagtccgttatcaacttgaaaaagtggcaccgagtcggtgcttttttt

SEQ ID NO: 834 - DNA, 103 bp, Artificial Sequence
  source: /note="Description of Artificial Sequence: Synthetic polynucleotide"
gtggtcacgagggtgggccagttttagagctagaaatagcaagttaaaataaggctagtccgttatcaacttgaaaaagtggcaccgagtcggtgcttttttt

SEQ ID NO: 835 - DNA, 103 bp, Artificial Sequence
  source: /note="Description of Artificial Sequence: Synthetic polynucleotide"
gtaggtcagggtggtcacgagttttagagctagaaatagcaagttaaaataaggctagtccgttatcaacttgaaaaagtggcaccgagtcggtgcttttttt

SEQ ID NO: 836 - DNA, 103 bp, Artificial Sequence
  source: /note="Description of Artificial Sequence: Synthetic polynucleotide"
gtggtcccgagggtgggccagttttagagctagaaatagcaagttaaaataaggctagtccgttatcaacttgaaaaagtggcaccgagtcggtgcttttttt

SEQ ID NO: 837 - DNA, 103 bp, Artificial Sequence
  source: /note="Description of Artificial Sequence: Synthetic polynucleotide"
gtaggtcagggtggtaaagagttttagagctagaaatagcaagttaaaataaggctagtccgttatcaacttgaaaaagtggcaccgagtcggtgcttttttt

SEQ ID NO: 838 - DNA, 103 bp, Artificial Sequence
  source: /note="Description of Artificial Sequence: Synthetic polynucleotide"
ggtacctatcgattgtcagggttttagagctagaaatagcaagttaaaataaggctagtccgttatcaacttgaaaaagtggcaccgagtcggtgcttttttt

SEQ ID NO: 839 - DNA, 103 bp, Artificial Sequence
  source: /note="Description of Artificial Sequence: Synthetic polynucleotide"
caggacggtcacctttgggggttttagagctagaaatagcaagttaaaataaggctagtccgttatcaacttgaaaaagtggcaccgagtcggtgcttttttt

SEQ ID NO: 840 - DNA, 103 bp, Artificial Sequence
  source: /note="Description of Artificial Sequence: Synthetic polynucleotide"
ggtgacaagtgtgatcacttgttttagagctagaaatagcaagttaaaataaggctagtccgttatcaacttgaaaaagtggcaccgagtcggtgcttttttt

SEQ ID NO: 841 - DNA, 103 bp, Artificial Sequence
  source: /note="Description of Artificial Sequence: Synthetic polynucleotide"
cacacttgtcaccaccccaagttttagagctagaaatagcaagttaaaataaggctagtccgttatcaacttgaaaaagtggcaccgagtcggtgcttttttt

SEQ ID NO: 842 - DNA, 106 bp, Artificial Sequence
  source: /note="Description of Artificial Sequence: Synthetic polynucleotide"
gggactttccgggactttccggggactttccgggactttccggggactttccgggactttccaagcttagacactagagggtatataatggaagctcgacttccag

SEQ ID NO: 843 - DNA, 135 bp, Artificial Sequence
  source: /note="Description of Artificial Sequence: Synthetic polynucleotide"
gcaccagacagtgacgtcagctgccagatcccatggccgtcatactgtgacgtctttcagacaccccattgacgtcaatgggagaacagataagcttagacactagagggtatataatggaagctcgacttccag

SEQ ID NO: 844 - DNA, 169 bp, Artificial Sequence
  source: /note="Description of Artificial Sequence: Synthetic polynucleotide"
agccagacaaagccagacaaaagccagacaaagccagacaaaagccagacaaagccagacaaaagccagacaaagccagacaaaagccagacaaagccagacaaaagccagacaaagccagacaaaagcttagacactagagggtatataatggaagctcgacttccag

SEQ ID NO: 845 - DNA, 86 bp, Artificial Sequence
  source: /note="Description of Artificial Sequence: Synthetic oligonucleotide"
attgcgcaatattgcgcaatcattgcgcaatattgcgcaatcaagcttagacactagagggtatataatggaagctcgacttccag

SEQ ID NO: 846 - DNA, 170 bp, Artificial Sequence
  source: /note="Description of Artificial Sequence: Synthetic polynucleotide"
caggatgtccatattaggacacaggatgtccatattaggacacaggatgtccatattaggacacaggatgtccatattaggacacaggatgtccatattaggacacaggatgtccatattaggacaaagcttagacactagagggtatataatggaagctcgacttccag

SEQ ID NO: 847 - DNA, 135 bp, Artificial Sequence
  source: /note="Description of Artificial Sequence: Synthetic polynucleotide"
cggaggaaaaactgtttcatacagaaggcgtggaggaaaaactgtttcatacagaaggcgtggaggaaaaactgtttcatacagaaggcgtagatctagactctagagggtatataatggaagctcgaattccag

SEQ ID NO: 848 - DNA, 74 bp, Artificial Sequence
  source: /note="Description of Artificial Sequence: Synthetic oligonucleotide"
agaacaaaatgtaccggtacattttgttctaagcttagacactagagggtatataatggaagctcgacttccag

SEQ ID NO: 849 - DNA, 170 bp, Artificial Sequence
  source: /note="Description of Artificial Sequence: Synthetic polynucleotide"
tgagttctcacgctagcagattgagttctcacgctagcagattgagttctcacgctagcagattgagttctcacgctagcagattgagttctcacgctagcagattgagttctcacgctagcagataagcttagacactagagggtatataatggaagctcgacttccag

SEQ ID NO: 850 - DNA, 106 bp, Artificial Sequence
  source: /note="Description of Artificial Sequence: Synthetic polynucleotide"
ctgactcagcctgagtcagcactgactcagcctgagtcagcactgactcagcctgagtcagcaagcttagacactagagggtatataatggaagctcgacttccag

SEQ ID NO: 851 - DNA, 176 bp, Artificial Sequence
  source: /note="Description of Artificial Sequence: Synthetic polynucleotide"
ggaagcgaaaatgaaattgactggaagcgaaaatgaaattgactggaagcgaaaatgaaattgactggaagcgaaaatgaaattgactggaagcgaaaatgaaattgactggaagcgaaaatgaaattgactaagcttagacactagagggtatataatggaagctcgacttccag

SEQ ID NO: 852 - DNA, 134 bp, Artificial Sequence
  source: /note="Description of Artificial Sequence: Synthetic polynucleotide"
tagtttcactttccctagtttcactttccctagtttcactttccctagtttcactttccctagtttcactttccctagtttcactttcccaagcttagacactagagggtatataatggaagctcgacttccag

SEQ ID NO: 853 - DNA, 116 bp, Artificial Sequence
  source: /note="Description of Artificial Sequence: Synthetic polynucleotide"
tttcgcgggaaatttcgcgggaaatttcgcgggaaatttcgcgggaaatttcgcgggaaatttcgcgggaaaaagcttagacactagagggtatataatggaagctcgacttccag

SEQ ID NO: 854 - DNA, 161 bp, Artificial Sequence
  source: /note="Description of Artificial Sequence: Synthetic polynucleotide"
gaacgttcccgaagaacgttcccgaagaacgttcccgaagaacgttcccgaagaacgttcccgaagaacgttcccgaagaacgttcccgaagaacgttcccgaagaacgttcccgaaaagcttagacactagagggtatataatggaagctcgacttccag

SEQ ID NO: 855 - DNA, 170 bp, Artificial Sequence
  source: /note="Description of Artificial Sequence: Synthetic polynucleotide"
ggcattctctatctgattgttggcattctctatctgattgttggcattctctatctgattgttggcattctctatctgattgttggcattctctatctgattgttggcattctctatctgattgttaagcttagacactagagggtatataatggaagctcgacttccag

SEQ ID NO: 856 - DNA, 179 bp, Artificial Sequence
  source: /note="Description of Artificial Sequence: Synthetic polynucleotide"
ctcgagacaggtgctgacgtggcattcctcgagacaggtgctgacgtggcattcctcgagacaggtgctgacgtggcattcctcgagacaggtgctgacgtggcattcctcgagacaggtgctgacgtggcattcaagcttagacactagagggtatataatggaagctcgacttccag

SEQ ID NO: 857 - DNA, 189 bp, Artificial Sequence
  source: /note="Description of Artificial Sequence: Synthetic polynucleotide"
ccttcaccaatcggcggcctccacgacggccttcaccaatcggcggcctccacgacggccttcaccaatcggcggcctccacgacggccttcaccaatcggcggcctccacgacggccttcaccaatcggcggcctccacgacggaagcttagacactagagggtatataatggaagctcgacttccag

SEQ ID NO: 858 - DNA, 146 bp, Artificial Sequence
  source: /note="Description of Artificial Sequence: Synthetic polynucleotide"
aggtcaccaggaggtcaaggtcaccaggaggtcaaggtcaccaggaggtcaaggtcaccaggaggtcaaggtcaccaggaggtcaaggtcaccaggaggtcaaagcttagacactagagggtatataatggaagctcgacttccag

SEQ ID NO: 859 - DNA, 128 bp, Artificial Sequence
  source: /note="Description of Artificial Sequence: Synthetic polynucleotide"
aggtcacaggtcacaggtcacaggtcacaggtcacaggtcacaggtcacaggtcacaggtcacaggtcacaggtcacaggtcacaagcttagacactagagggtatataatggaagctcgacttccag

SEQ ID NO: 860 - DNA, 164 bp, Artificial Sequence
  source: /note="Description of Artificial Sequence: Synthetic polynucleotide"
gatccacaaggttcacgaggttcacgtccggatccacaaggttcacgaggttcacgtccggatccacaaggttcacgaggttcacgtccggatccacaaggttcacgaggttcacgtccgaagcttagacactagagggtatataatggaagctcgacttccag

SEQ ID NO: 861 - DNA, 158 bp, Artificial Sequence
  source: /note="Description of Artificial Sequence: Synthetic polynucleotide"
tagcttggaaatgacattgctaatggtgacaaagcaacttttagcttggaaatgacattgctaatggtgacaaagcaactttctcgaggatatcaagatctggcctcggcggccaagcttagacactagagggtatataatggaagctcgacttccag

SEQ ID NO: 862 - DNA, 169 bp, Artificial Sequence
  source: /note="Description of Artificial Sequence: Synthetic polynucleotide"
gtcgacatttcccgtaaatcgtcgagtcgacatttcccgtaaatcgtcgagtcgacatttcccgtaaatcgtcgagtcgacatttcccgtaaatcgtcgagtcgacatttcccgtaaatcgtcgaaagcttagacactagagggtatataatggaagctcgacttccag

SEQ ID NO: 863 - DNA, 23 bp, Artificial Sequence
  source: /note="Description of Artificial Sequence: Synthetic oligonucleotide"
cctgaggcaagctgcccgtgccc

SEQ ID NO: 864 - DNA, 23 bp, Artificial Sequence
  source: /note="Description of Artificial Sequence: Synthetic oligonucleotide"
ccctcaaaaccaccctgacctac

SEQ ID NO: 865 - DNA, 33 bp, Artificial Sequence
  source: /note="Description of Artificial Sequence: Synthetic oligonucleotide"
ccctggcccaccctcgggaccaccctgacctac

What is claimed is:

1. A cell data recorder system comprising:
   (a) a writing plasmid comprising:
      (i) a nucleic acid sequence encoding a nucleic acid programmable DNA binding protein (napDNAbp) operably linked to a first promoter; and
      (ii) a nucleic acid sequence encoding a single guide RNA (sgRNA) operably linked to a second promoter, wherein the sgRNA is complementary to a target sequence,
      wherein at least one of the promoters is an inducible promoter, and wherein the sgRNA associates with the napDNAbp under conditions that induce expression of the sgRNA and expression of the napDNAbp;
   (b) a first recording plasmid comprising the target sequence; and
   (c) a second recording plasmid not comprising the target sequence.

2. The cell data recording system of claim 1, wherein the first promoter is a constitutive promoter.

3. The cell data recording system of claim 1, wherein the second promoter is a constitutive promoter.

4. The cell data recording system of claim 1, wherein the napDNAbp is a Cas9 domain.

5. The cell data recording system of claim 4, wherein the Cas9 domain comprises the amino acid sequence of any one of SEQ ID NOs: 10-260.

6. An isolated cell comprising the cell data recording system of claim 1.

7. The cell of claim 6, wherein the cell is a prokaryotic cell.

8. The cell of claim 6, wherein the cell is a eukaryotic cell.

9. A method for recording the presence and/or duration of a stimulus in a cell comprising detecting a change in the ratio of the first recording plasmid to the second recording plasmid in the cell of any one of claims 6 to 8, wherein exposure to the stimulus results in expression of the sgRNA and expression of the napDNAbp in the cell.

10. The method of claim 9, wherein the stimulus is a small molecule, a protein, a peptide, an amino acid, a metabolite, an inorganic molecule, an organometallic molecule, an organic molecule, a drug or drug candidate, a sugar, a lipid, a metal, a nucleic acid, a molecule produced during the activation of an endogenous or an exogenous signaling cascade, light, heat, sound, pressure, mechanical stress, shear stress, or a virus or other microorganism, change in pH, or change in oxidation/reduction state.

* * * * *

UNITED STATES PATENT AND TRADEMARK OFFICE
CERTIFICATE OF CORRECTION

| | | |
|---|---|---|
| PATENT NO. | : 12,060,586 B2 | Page 1 of 1 |
| APPLICATION NO. | : 16/970115 | |
| DATED | : August 13, 2024 | |
| INVENTOR(S) | : David R. Liu et al. | |

It is certified that error appears in the above-identified patent and that said Letters Patent is hereby corrected as shown below:

In the Specification

At Column 1, Line number 13, please add:
--Government Support
This invention was made with government support under grants HG009490, EB022376, and GM118062 awarded by the National Institutes of Health. The government has certain rights in the invention.--

Signed and Sealed this
Thirtieth Day of September, 2025

John A. Squires
*Director of the United States Patent and Trademark Office*